United States Patent
Sato et al.

(10) Patent No.: US 12,201,857 B2
(45) Date of Patent: Jan. 21, 2025

(54) METHODS AND COMPOSITIONS RELATING TO COVID ANTIBODY EPITOPES

(71) Applicant: Twist Bioscience Corporation, South San Francisco, CA (US)

(72) Inventors: Aaron Sato, Burlingame, CA (US); Qiang Liu, Palo Alto, CA (US); Tom Yuan, San Francisco, CA (US)

(73) Assignee: Twist Bioscience Corporation, South San Francisco, CA (US)

( * ) Notice: Subject to any disclaimer, the term of this patent is extended or adjusted under 35 U.S.C. 154(b) by 0 days.

(21) Appl. No.: 17/847,104

(22) Filed: Jun. 22, 2022

(65) Prior Publication Data

US 2023/0002478 A1    Jan. 5, 2023

Related U.S. Application Data

(60) Provisional application No. 63/213,627, filed on Jun. 22, 2021.

(51) Int. Cl.
   A61P 31/14      (2006.01)
   A61K 39/00      (2006.01)
   C07K 16/10      (2006.01)

(52) U.S. Cl.
   CPC .......... *C07K 16/1003* (2023.08); *A61P 31/14* (2018.01); *A61K 2039/505* (2013.01); *C07K 2317/24* (2013.01); *C07K 2317/565* (2013.01)

(58) Field of Classification Search
   CPC .............. C07K 16/10; C07K 2317/24; C07K 2317/565; A61P 31/14; A61K 2039/505
   See application file for complete search history.

(56) References Cited

U.S. PATENT DOCUMENTS 5,368,823 A   11/1994   McGraw et al.
5,474,796 A   12/1995   Brennan
(Continued)

FOREIGN PATENT DOCUMENTS

CN   101277758 A   10/2008
EP     3030682 A2    6/2016
(Continued)

OTHER PUBLICATIONS

Chen et al., Enhancement and destruction of antibody function by somatic mutation: unequal occurrence is controlled by V gene combinatorial associations. Embo J. Jun. 15, 1995;14(12):2784-94. (Year: 1995).*

(Continued)

*Primary Examiner* — Aurora M Fontainhas
*Assistant Examiner* — Selam Berhane
(74) *Attorney, Agent, or Firm* — Helene Laville; HEFIP, LLC

(57) ABSTRACT

Provided herein are methods and compositions relating to libraries of optimized antibodies having nucleic acids encoding for an antibody comprising modified sequences. Libraries described herein comprise nucleic acids encoding SARS-CoV-2 or ACE2 antibodies. Further described herein are protein libraries generated when the nucleic acid libraries are translated. Further described herein are cell libraries expressing variegated nucleic acid libraries described herein.

2 Claims, 99 Drawing Sheets
(30 of 99 Drawing Sheet(s) Filed in Color)
Specification includes a Sequence Listing.

(56) References Cited

U.S. PATENT DOCUMENTS

| | | |
|---|---|---|
| 5,534,507 A | 7/1996 | Cama et al. |
| 5,677,195 A | 10/1997 | Winkler et al. |
| 5,843,767 A | 12/1998 | Beattie |
| 6,013,440 A | 1/2000 | Lipshutz et al. |
| 6,028,189 A | 2/2000 | Blanchard |
| 6,419,883 B1 | 7/2002 | Blanchard |
| 6,472,147 B1 | 10/2002 | Janda et al. |
| 6,492,107 B1 | 12/2002 | Kauffman et al. |
| 6,893,816 B1 | 5/2005 | Beattie |
| 7,163,660 B2 | 1/2007 | Lehmann |
| 7,202,264 B2 | 4/2007 | Ravikumar et al. |
| 8,198,071 B2 | 6/2012 | Goshoo et al. |
| 9,403,141 B2 | 8/2016 | Banyai et al. |
| 9,409,139 B2 | 8/2016 | Banyai et al. |
| 9,555,388 B2 | 1/2017 | Banyai et al. |
| 9,677,067 B2 | 6/2017 | Toro et al. |
| 9,745,619 B2 | 8/2017 | Rabbani et al. |
| 9,765,387 B2 | 9/2017 | Rabbani et al. |
| 9,833,761 B2 | 12/2017 | Banyai et al. |
| 9,839,894 B2 | 12/2017 | Banyai et al. |
| 9,889,423 B2 | 2/2018 | Banyai et al. |
| 9,895,673 B2 | 2/2018 | Peck et al. |
| 9,981,239 B2 | 5/2018 | Banyai et al. |
| 10,053,688 B2 | 8/2018 | Cox |
| 10,272,410 B2 | 4/2019 | Banyai et al. |
| 10,384,188 B2 | 8/2019 | Banyai et al. |
| 10,384,189 B2 | 8/2019 | Peck |
| 10,417,457 B2 | 9/2019 | Peck |
| 10,583,415 B2 | 3/2020 | Banyai et al. |
| 10,618,024 B2 | 4/2020 | Banyai et al. |
| 10,632,445 B2 | 4/2020 | Banyai et al. |
| 10,639,609 B2 | 5/2020 | Banyai et al. |
| 10,669,304 B2 | 6/2020 | Indermuhle et al. |
| 10,744,477 B2 | 8/2020 | Banyai et al. |
| 10,754,994 B2 | 8/2020 | Peck |
| 10,773,232 B2 | 9/2020 | Banyai et al. |
| 10,844,373 B2 | 11/2020 | Cox et al. |
| 10,894,242 B2 | 1/2021 | Marsh et al. |
| 10,894,959 B2 | 1/2021 | Cox et al. |
| 10,907,274 B2 | 2/2021 | Cox |
| 10,936,953 B2 | 3/2021 | Bramlett et al. |
| 10,969,965 B2 | 4/2021 | Malina et al. |
| 10,975,372 B2 | 4/2021 | Cox et al. |
| 10,987,648 B2 | 4/2021 | Peck et al. |
| 11,185,837 B2 | 11/2021 | Banyai et al. |
| 11,214,798 B2 | 1/2022 | Brown |
| 11,263,354 B2 | 3/2022 | Peck |
| 11,332,738 B2 | 5/2022 | Nugent et al. |
| 11,332,740 B2 | 5/2022 | Nugent et al. |
| 11,377,676 B2 | 7/2022 | Wu et al. |
| 11,407,837 B2 | 8/2022 | Glanville |
| 2001/0018512 A1 | 8/2001 | Blanchard |
| 2002/0025561 A1 | 2/2002 | Hodgson |
| 2002/0094533 A1 | 7/2002 | Hess et al. |
| 2002/0095073 A1 | 7/2002 | Jacobs et al. |
| 2002/0160536 A1 | 10/2002 | Regnier et al. |
| 2002/0164824 A1 | 11/2002 | Xiao et al. |
| 2003/0120035 A1 | 6/2003 | Gao et al. |
| 2003/0171325 A1 | 9/2003 | Gascoyne et al. |
| 2004/0087008 A1 | 5/2004 | Schembri |
| 2004/0259146 A1 | 12/2004 | Friend et al. |
| 2005/0137805 A1 | 6/2005 | Lewin et al. |
| 2005/0227235 A1 | 10/2005 | Carr et al. |
| 2006/0127920 A1 | 6/2006 | Church et al. |
| 2007/0196834 A1 | 8/2007 | Cerrina et al. |
| 2008/0085511 A1 | 4/2008 | Peck et al. |
| 2008/0085514 A1 | 4/2008 | Peck et al. |
| 2008/0227160 A1 | 9/2008 | Kool |
| 2008/0287320 A1 | 11/2008 | Baynes et al. |
| 2008/0300842 A1 | 12/2008 | Govindarajan et al. |
| 2009/0062129 A1 | 3/2009 | McKernan et al. |
| 2009/0239759 A1 | 9/2009 | Balch |
| 2009/0285825 A1 | 11/2009 | Kini et al. |
| 2010/0004143 A1 | 1/2010 | Shibahara |
| 2010/0099103 A1 | 4/2010 | Hsieh et al. |
| 2010/0111768 A1 | 5/2010 | Banerjee et al. |
| 2010/0216648 A1 | 8/2010 | Staehler et al. |
| 2010/0311960 A1 | 12/2010 | Dellinger |
| 2011/0172127 A1 | 7/2011 | Jacobson et al. |
| 2011/0217738 A1 | 9/2011 | Jacobson |
| 2012/0129704 A1 | 5/2012 | Gunderson et al. |
| 2012/0164691 A1 | 6/2012 | Eshoo et al. |
| 2012/0231968 A1 | 9/2012 | Bruhn et al. |
| 2012/0264653 A1 | 10/2012 | Carr et al. |
| 2013/0017642 A1 | 1/2013 | Milgrew et al. |
| 2013/0017977 A1 | 1/2013 | Oleinikov |
| 2013/0065017 A1 | 3/2013 | Sieber |
| 2013/0109595 A1 | 5/2013 | Routenberg |
| 2013/0109596 A1 | 5/2013 | Peterson et al. |
| 2013/0130321 A1 | 5/2013 | Staehler et al. |
| 2013/0165328 A1 | 6/2013 | Previte et al. |
| 2014/0106394 A1 | 4/2014 | Ko et al. |
| 2014/0178992 A1 | 6/2014 | Nakashima et al. |
| 2015/0038373 A1 | 2/2015 | Banyai et al. |
| 2015/0120265 A1 | 4/2015 | Amirav-Drory et al. |
| 2015/0196917 A1 | 7/2015 | Kay et al. |
| 2016/0089651 A1 | 3/2016 | Banyai |
| 2016/0090592 A1 | 3/2016 | Banyai et al. |
| 2016/0096160 A1 | 4/2016 | Banyai et al. |
| 2016/0251651 A1 | 9/2016 | Banyai et al. |
| 2016/0303535 A1 | 10/2016 | Banyai et al. |
| 2016/0333340 A1 | 11/2016 | Wu |
| 2016/0339409 A1 | 11/2016 | Banyai et al. |
| 2016/0340672 A1 | 11/2016 | Banyai et al. |
| 2016/0354752 A1 | 12/2016 | Banyai et al. |
| 2017/0081716 A1 | 3/2017 | Peck |
| 2017/0095785 A1 | 4/2017 | Banyai et al. |
| 2017/0159044 A1 | 6/2017 | Toro et al. |
| 2017/0327819 A1 | 11/2017 | Banyai et al. |
| 2017/0355756 A1* | 12/2017 | Julien .................. C07K 16/18 |
| 2017/0357752 A1 | 12/2017 | Diggans |
| 2017/0362589 A1 | 12/2017 | Banyai et al. |
| 2018/0029001 A1 | 2/2018 | Banyai et al. |
| 2018/0104664 A1 | 4/2018 | Fernandez |
| 2018/0142289 A1 | 5/2018 | Zeitoun et al. |
| 2018/0253563 A1 | 9/2018 | Peck et al. |
| 2018/0264428 A1 | 9/2018 | Banyai et al. |
| 2018/0282721 A1 | 10/2018 | Cox et al. |
| 2018/0326388 A1 | 11/2018 | Banyai et al. |
| 2019/0314783 A1 | 10/2019 | Banyai et al. |
| 2019/0352635 A1 | 11/2019 | Toro et al. |
| 2019/0366293 A1 | 12/2019 | Banyai et al. |
| 2019/0366294 A1 | 12/2019 | Banyai et al. |
| 2020/0017907 A1 | 1/2020 | Zeitoun et al. |
| 2020/0102611 A1 | 4/2020 | Zeitoun et al. |
| 2020/0156037 A1 | 5/2020 | Banyai et al. |
| 2020/0181667 A1 | 6/2020 | Wu et al. |
| 2020/0222875 A1 | 7/2020 | Peck et al. |
| 2020/0283760 A1 | 9/2020 | Nugent et al. |
| 2020/0299322 A1 | 9/2020 | Indermuhle et al. |
| 2020/0299684 A1 | 9/2020 | Toro et al. |
| 2020/0308575 A1 | 10/2020 | Sato |
| 2020/0325235 A1 | 10/2020 | Tabibiazar et al. |
| 2020/0330953 A1 | 10/2020 | Banyai et al. |
| 2021/0002710 A1 | 1/2021 | Gantt et al. |
| 2021/0040476 A1 | 2/2021 | Cox et al. |
| 2021/0071168 A1 | 3/2021 | Nugent et al. |
| 2021/0102192 A1 | 4/2021 | Tabibiazar et al. |
| 2021/0102195 A1 | 4/2021 | Sato et al. |
| 2021/0102198 A1 | 4/2021 | Cox et al. |
| 2021/0115594 A1 | 4/2021 | Cox et al. |
| 2021/0129108 A1 | 5/2021 | Marsh et al. |
| 2021/0142182 A1 | 5/2021 | Bramlett et al. |
| 2021/0170356 A1 | 6/2021 | Peck et al. |
| 2021/0179724 A1 | 6/2021 | Sato et al. |
| 2021/0180046 A1 | 6/2021 | Cox et al. |
| 2021/0207197 A1 | 7/2021 | Gantt et al. |
| 2021/0332078 A1 | 10/2021 | Wu |
| 2021/0340225 A1* | 11/2021 | Grosveld ............... A61P 31/14 |
| 2021/0348220 A1 | 11/2021 | Zeitoun et al. |
| 2021/0355194 A1 | 11/2021 | Sato et al. |
| 2021/0395344 A1 | 12/2021 | Sato et al. |
| 2022/0032256 A1 | 2/2022 | Lackey et al. |
| 2022/0064206 A1 | 3/2022 | Fernandez et al. |

(56) References Cited

U.S. PATENT DOCUMENTS

| | | |
|---|---|---|
| 2022/0064313 A1 | 3/2022 | Sato et al. |
| 2022/0064628 A1 | 3/2022 | Toro et al. |
| 2022/0106586 A1 | 4/2022 | Nugent et al. |
| 2022/0106590 A1 | 4/2022 | Arbiza et al. |
| 2022/0135690 A1 | 5/2022 | Sato et al. |
| 2022/0135965 A1 | 5/2022 | Gantt et al. |
| 2022/0138354 A1 | 5/2022 | Peck |
| 2022/0145289 A1 | 5/2022 | Lackey et al. |
| 2022/0206001 A1* | 6/2022 | Sato ............... G01N 33/56983 |
| 2022/0243195 A1 | 8/2022 | Nugent et al. |
| 2022/0246236 A1 | 8/2022 | Amirav-Drory |
| 2022/0259319 A1 | 8/2022 | Sato et al. |
| 2022/0259638 A1 | 8/2022 | Brown |
| 2022/0277808 A1 | 9/2022 | Arbiza et al. |
| 2022/0281989 A1 | 9/2022 | Glanville |

FOREIGN PATENT DOCUMENTS

| | | | |
|---|---|---|---|
| JP | H07505530 A | 6/1995 | |
| JP | 2001518086 A | 10/2001 | |
| JP | 2002538790 A | 11/2002 | |
| JP | 2006503586 A | 2/2006 | |
| JP | 2008214343 A | 9/2008 | |
| JP | 2009294195 A | 12/2009 | |
| JP | 2016527313 A | 9/2016 | |
| WO | WO-9320242 A1 | 10/1993 | |
| WO | WO-02072791 A2 | 9/2002 | |
| WO | WO-2005059096 A2 | 6/2005 | |
| WO | WO-2008054543 A2 | 5/2008 | |
| WO | WO-2008063135 A1 | 5/2008 | |
| WO | WO-2008068048 A2 * | 6/2008 | ............... A61P 31/10 |
| WO | WO-2011109031 A1 | 9/2011 | |
| WO | WO-2012078312 A2 | 6/2012 | |
| WO | WO-2012154201 A1 | 11/2012 | |
| WO | WO-2014021938 A1 | 2/2014 | |
| WO | WO-2015021080 A2 | 2/2015 | |
| WO | WO-2022010934 A2 | 1/2022 | |
| WO | WO-2022076326 A1 | 4/2022 | |
| WO | WO-2022086866 A1 | 4/2022 | |
| WO | WO-2022087293 A1 | 4/2022 | |
| WO | WO-2022098662 A2 | 5/2022 | |
| WO | WO-2022159620 A1 | 7/2022 | |
| WO | WO-2022178137 A1 | 8/2022 | |

OTHER PUBLICATIONS

Edwards et al., The remarkable flexibility of the human antibody repertoire; isolation of over one thousand different antibodies to a single protein, BLyS. J Mol Biol. Nov. 14, 2003;334(1):103-18. (Year: 2003).*

Koenig et al., Mutational landscape of antibody variable domains reveals a switch modulating the interdomain conformational dynamics and antigen binding. PNAS Jan. 24, 2017 114 (4) E486-E495; first published Jan. 5, 2017; (Year: 2017).*

Kussie, Paul H., "A Single Engineered Amino Acid Substitution Changes Antibody Fine Specificity", 1994, Journal of Immunology 152(1): pp. 146-152. (Year: 1994).*

Agbavwe et al.: Efficiency, Error and Yield in Light-Directed Maskless Synthesis of DNA Microarrays. Journal of Nanobiotechnology. 9(57):1-17 (2011).

Arkles et al.: The Role of Polarity in the Structure of Silanes Employed in Surface Modification. Silanes and Other Coupling Agents. 5:51-64 (2009).

ATDBio. Nucleic Acid Structure, Nucleic Acids Book, 9 pages, published on Jan. 22, 2005. from: http://www.atdbio.com/content/5/Nucleic-acid-structure.

ATDBio. Solid-Phase Oligonucleotide Synthesis, Nucleic Acids Book, 20 pages, Published on Jul. 31, 2011. from: http://www.atdbio.com/content/17/Solid-phase-oligonucleotide-synthesis.

Berg: Biochemistry. 5th ED. New York (2002) 148-149.

Blanchard et al.: High-Density Oligonucleotide Arrays. Biosensors & Bioelectronics, 11(6/7):687-690 (1996).

Buermans et al.: Next Generation sequencing technology: Advances and applications, Biochimica et Biophysica Acta (BBA)—Molecular Basis of Disease, 1842:1931-1941 (2014).

Cheng et al.: High throughput parallel synthesis of oligonucleotides with 1536 channel synthesizer. Nucleic Acids Res. 30(18):e93 (2002).

Cleary et al.: Production of complex nucleic acid libraries using highly parallel in situ oligonucleotide synthesis. Nat Methods. 1(3):241-248 (2004).

Cohen et al.: Human population: The next half century. Science. 302:1172-1175 (2003).

Cruse et al.: Atlas of Immunology. Third Edition. Boca Raton:CRC Press (pp. 282-283) (2010).

Elsik et al.: The Genome sequence of taurine cattle: A window of ruminant biology and evolution. Science. 324:522-528 (2009).

Fodor et al.: Light-directed, spatially addressable parallel chemical synthesis. Science. 251(4995):767-773 (1991).

Gao et al.: A method for the generation of combinatorial antibody libraries using pIX phage display. PNAS 99(20):12612-12616 (2002).

GE Healthcare. AKTA oligopilot plus. Data File 18-114-66 ADC. 8 pages (2006).

GE Healthcare. Robust and cost-efficient oligonucleotide synthesis. Application Note 28-4058-08 AA. 4 pages (2005).

Gibson et al.: Creation of a Bacterial Cell Controlled by A Chemically Synthesized Genome. Science. 329(5989):52-56 (2010).

Hudson: Matrix Assisted Synthetic Transformations: A Mosaic of Diverse Contributions. Journal of Combinatorial Chemistry. 1(6):403-457 (1999).

Kong et al.: Parallel gene synthesis in a microfluidic device. Nucleic Acids Res. 35(8):e61 (2007).

Kosuri and Church. Large-scale de novo DNA synthesis: technologies and applications. Nature Methods. 11:499-507 (2014) Available at: http://www.nature.com/nmeth/journal/v11/n5/full/nmeth.2918.html.

Kosuri, et al. A scalable gene synthesis by selective amplification of DNA pools from high-fidelity microchips. Nature Biotechnology. 2010; 28:1295-1299.

Kosuri et al.: A scalable gene synthesis platform using high-fidelity DNA microchips Nat.Biotechnol. 28(12):1295-1299 (2010).

Krayden, Inc.: A Guide to Silane Solutions. Silane coupling agents. 7 pages. Published on May 31, 2005 at: http://krayden.com/pdf/xia_silane_chemistry.pdf.

Lausted et al.: POSaM: a fast, flexible, open-source, inkjet oligonucleotide synthesizer and microarrayer. Genome Biology. 5:R58, 17 pages (2004) available at https://www.ncbi.nlm.nih.gov/pmc/articles/PMC507883/.

Lebl et al.: Economical Parallel Oligonucleotide and Peptide Synthesizer—Pet Oligator. Int. J. Peptide Res. Ther. 13(1-2):367-376 (2007).

Leproust et al.: Synthesis of high-quality libraries of long (150mer) oligonucleotides by a novel depurination controlled process. Nucleic Acids Research. 38(8):2522-2540 (2010).

Lewontin and Harti, Population genetics in forensic DNA typing. Science, 254:1745-1750, 1991.

Ma et al.: DNA synthesis, assembly and application in synthetic biology. Current Opinion in Chemical Biology. 16:260-267 (2012).

Ma et al.: Versatile surface functionalization of cyclic olefin copolymer (COC) with sputtered $SiO_2$ thin film for potential BioMEMS applications. Journal of Materials Chemistry. 11 pages (2009).

Mazor et al.: Isolation of Full-Length IgG Antibodies from Combinatorial Libraries Expressed in *Escherichia coli*; Antony S. Dimitrov (ed.), Therapeutic Antibodies: Methods and Protocols, vol. 525, Chapter 11, pp. 217-239 (2009).

McBride & Caruthers. An investigation of several deoxynucleoside phosphoramidites useful for synthesizing deoxyoligonucleotides. Tetrahedron Lett. 24:245-248 (1983).

Mitra et al.: In situ localized amplification and contact replication of many individual DNA molecules. Nucleic Acids Res. 27(24):e34 (1999).

Morin et al.: Profiling the HeLa S3 transcriptome using randomly primed cDNA and massively parallel short-read sequencing. Biotechniques. 45:81-94 (2008).

Opposition to European Patent No. 3030682 filed Mar. 3, 2021.

(56) References Cited

OTHER PUBLICATIONS

PCT/US2014/049834 International Preliminary Report on Patentability dated Feb. 18, 2016.
PCT/US2014/049834 International Search Report and Written Opinion mailed Mar. 19, 2015.
PCT/US2014/049834 Invitation to Pay Additional Fees and, where applicable, protest fee mailed Jan. 5, 2015.
Pirrung. How to make a DNA chip. Angew. Chem. Int. Ed. 41:1276-1289 (2002).
Pray. Discovery of DNA Structure and Function: Watson and Crick. Nature Education.6 pages (2008) available at: http://www.nature.com/scitable/topicpage/discovery-of-dna-structure-and-function-watson-397.
Quan et al.: Parallel on-chip gene synthesis and application to optimization of protein expression. Nature Biotechnology. 29:449-452 (2011).
Rafalski and Morgante, Corn and humans: recombination and linkage disequilibrium in two genomes of similar size. Trends in Genetics. 20(2):103-111. (2004).
Rogozin et al.: Origin and evolution of spliceosomal introns. Biology Direct, 7:11 (2012).
Saaem et al.: In situ synthesis of DNA microarray on functionalized cyclic olefin copolymer substrate ACS Applied Materials & Interfaces. 2(2):491-497 (2010).
Sargolzaei et al.: Extent of linkage disequilibrium in Holstein cattle in North America. J.Dairy Science. 91:2106-2117 (2007).
Srivannavit et al.: Design and fabrication of microwell array chips for a solution-based, photogenerated acid-catalyzed parallel oligonucleotide DNA synthesis. Sensors and Actuators A. 116:150-160 (2004).
Steel. The Flow-Thru Chip A Three-dimensional biochip platform. In: Schena, Microarray Biochip Technology, Chapter 5, Natick, MA: Eaton Publishing, 2000, 33 pages.
Taylor et al.: Impact of surface chemistry and blocking strategies on DNA microarrays. Nucleic Acids Research, 31(16):e87 19 pages (2003).
Tian et al.: Accurate multiplex gene synthesis from programmable DNA microchips. Nature. 432(7020):1050-1054 (2004).
U.S. Appl. No. 16/737,401 Final Office Action dated Jun. 13, 2022.
U.S. Appl. No. 14/452,429 Notice of Allowance dated Jun. 7, 2016.
U.S. Appl. No. 14/452,429 Office Action mailed Apr. 9, 2015.
U.S. Appl. No. 14/452,429 Office Action mailed Oct. 21, 2015.
U.S. Appl. No. 14/452,429 Restriction Requirement mailed Dec. 12, 2014.
U.S. Appl. No. 14/885,962 Notice of Allowance dated Nov. 8, 2017 and Sep. 29, 2017.
U.S. Appl. No. 14/885,962 Office Action dated Dec. 16, 2016.
U.S. Appl. No. 14/885,962 Office Action dated Sep. 8, 2016.
U.S. Appl. No. 14/885,962 Restriction Requirement dated Mar. 1, 2016.
U.S. Appl. No. 14/885,963 Notice of Allowance dated May 24, 2016.
U.S. Appl. No. 14/885,963 Office Action dated Feb. 5, 2016.
U.S. Appl. No. 14/885,965 Office Action dated Aug. 28, 2018.
U.S. Appl. No. 14/885,965 Office Action dated Aug. 30, 2017.
U.S. Appl. No. 14/885,965 Office Action dated Feb. 10, 2017.
U.S. Appl. No. 14/885,965 Office Action dated Feb. 18, 2016.
U.S. Appl. No. 14/885,965 Office Action dated Jan. 4, 2018.
U.S. Appl. No. 14/885,965 Office Action dated Jul. 7, 2016.
U.S. Appl. No. 15/187,714 Final Office Action dated Sep. 17, 2019.
U.S. Appl. No. 15/187,714 Office Action dated Apr. 4, 2019.
U.S. Appl. No. 15/187,714 Restriction Requirement dated Sep. 17, 2018.
U.S. Appl. No. 15/187,721 Notice of Allowance dated Dec. 7, 2016.
U.S. Appl. No. 15/187,721 Office Action dated Oct. 14, 2016.
U.S. Appl. No. 15/233,835 Notice of Allowance dated Oct. 4, 2017.
U.S. Appl. No. 15/233,835 Office Action dated Feb. 8, 2017.
U.S. Appl. No. 15/233,835 Office Action dated Jul. 26, 2017.
U.S. Appl. No. 15/233,835 Restriction Requirement dated Nov. 4, 2016.
U.S. Appl. No. 15/245,054 Notice of Allowance dated Dec. 14, 2017.
U.S. Appl. No. 15/245,054 Office Action dated Mar. 21, 2017.
U.S. Appl. No. 15/245,054 Office Action dated Oct. 19, 2016.
U.S. Appl. No. 15/377,547 Final Office Action dated Feb. 8, 2019.
U.S. Appl. No. 15/377,547 Office Action dated Jul. 27, 2018.
U.S. Appl. No. 15/377,547 Office Action dated Mar. 24, 2017.
U.S. Appl. No. 15/377,547 Office Action dated Nov. 30, 2017.
U.S. Appl. No. 15/602,991 Final Office Action dated Dec. 13, 2018.
U.S. Appl. No. 15/602,991 Notice of Allowance dated Oct. 25, 2017.
U.S. Appl. No. 15/602,991 Office Action dated May 31, 2018.
U.S. Appl. No. 15/602,991 Office Action dated May 31, 2019.
U.S. Appl. No. 15/602,991 Office Action dated Sep. 21, 2017.
U.S. Appl. No. 15/603,013 Final Office Action dated Nov. 6, 2019.
U.S. Appl. No. 15/603,013 Office Action dated Jan. 30, 2018.
U.S. Appl. No. 15/603,013 Office Action dated Jul. 10, 2018.
U.S. Appl. No. 15/603,013 Office Action dated Jun. 26, 2019.
U.S. Appl. No. 15/603,013 Office Action dated Oct. 20, 2017.
U.S. Appl. No. 15/729,564 Final Office Action dated Dec. 13, 2018.
U.S. Appl. No. 15/729,564 Office Action dated Jan. 8, 2018.
U.S. Appl. No. 15/729,564 Office Action dated Jun. 6, 2018.
U.S. Appl. No. 15/729,564 Office Action dated May 30, 2019.
U.S. Appl. No. 15/991,992 Office Action dated May 21, 2020.
U.S. Appl. No. 15/991,992 Restriction Requirement dated Mar. 10, 2020.
U.S. Appl. No. 16/039,256 Final Office Action dated Mar. 30, 2021.
U.S. Appl. No. 16/039,256 Office Action dated Aug. 20, 2020.
U.S. Appl. No. 16/039,256 Office Action dated May 10, 2022.
U.S. Appl. No. 16/039,256 Restriction Requirement dated May 18, 2020.
U.S. Appl. No. 16/409,608 Office Action dated Sep. 9, 2019.
U.S. Appl. No. 16/535,777 Final Office Action dated Oct. 20, 2020.
U.S. Appl. No. 16/535,777 Office Action dated Feb. 8, 2021.
U.S. Appl. No. 16/535,777 Office Action dated Jan. 23, 2020.
U.S. Appl. No. 16/535,779 First Action Interview dated Feb. 10, 2020.
U.S. Appl. No. 16/737,401 Office Action dated Jan. 5, 2022.
U.S. Appl. No. 16/737,401 Restriction Requirement dated Nov. 15, 2021.
Van Tassell et al.: SNP discovery and allele frequency estimation by deep sequencing of reduced representation libraries. Nature Methods. 5:247-252 (2008).
Xu et al.: Design of 240,000 orthogonal 25mer DNA barcode probes. PNAS. 106(7):2289-2294 (2009).

* cited by examiner

501Y.V2 variant, S African

| Spike | C21614T | L18F |
|---|---|---|
| | A21801C | D80A |
| | A22206G | D215G |
| | G22299T | R246I |
| RBD | G22813T | K417N |
| | G23012A | E484K |
| | A23063T | N501Y |
| | A23403G[1] | D614G |
| | G23664T | A701V |

B.1.1.7, 501Y.V1 variant, UK

| Spike | 21765–21770del | HV 69–70del |
|---|---|---|
| | 21991–21993del | Y144del |
| RBD | A23063T | N501Y |
| | C23271A | A570D |
| | C23604A | P681H |
| | C23709T | T716I |
| | T24506G | S982A |
| | G24914C | D1118H |

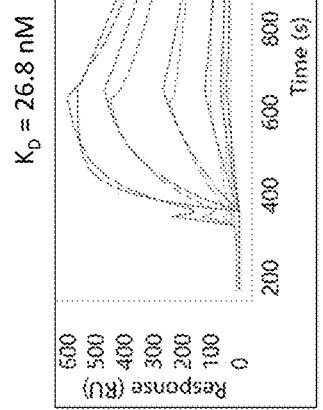
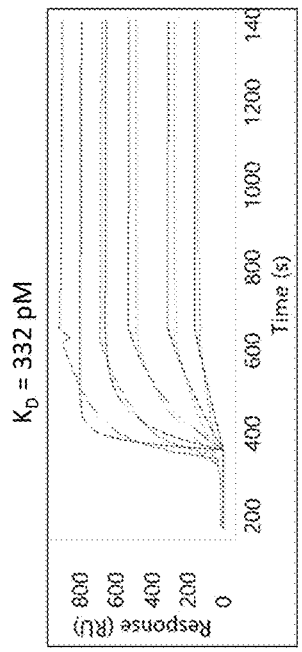
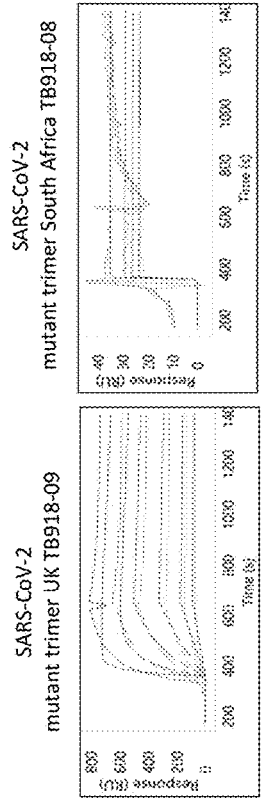
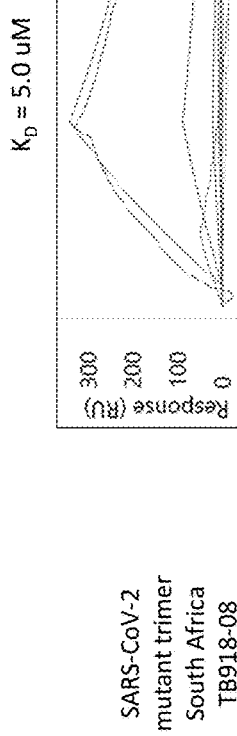
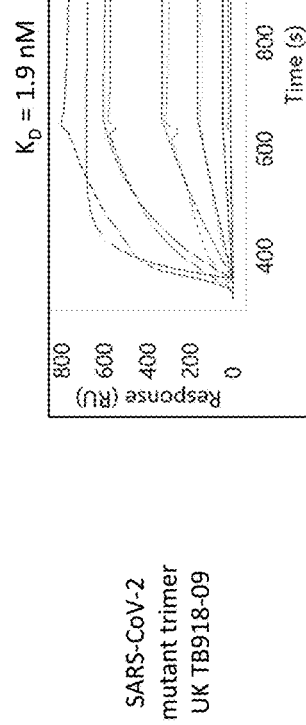
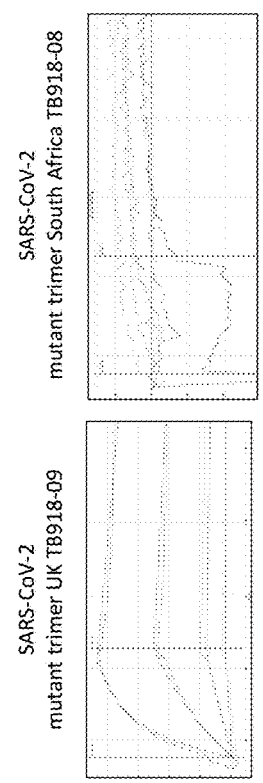
FIG. 9B

FIG. 10

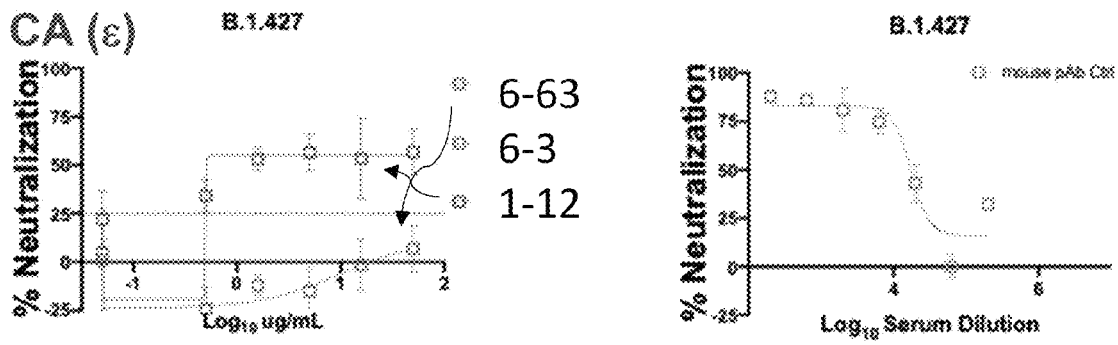
FIG. 11D
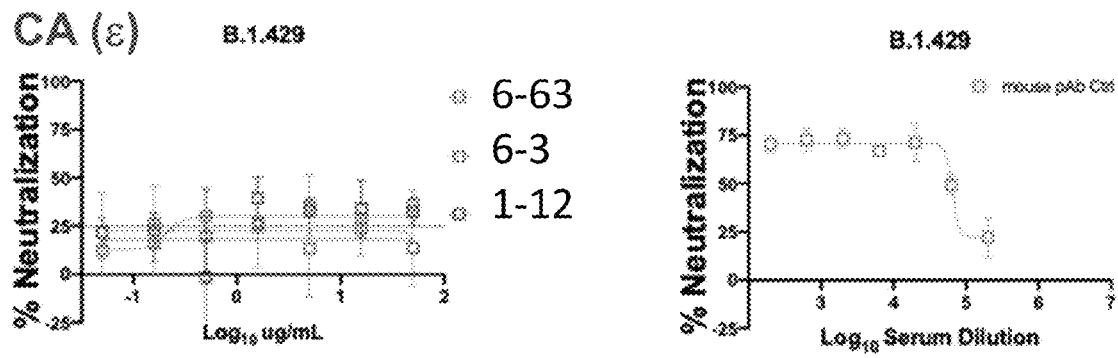
FIG. 11E
IC50s of variant antibodies against variant strains
| | SARS-CoV2 Type | 1-12 | 6-3 | 6-63 |
|---|---|---|---|---|
| Pseudovirus | WT | 0.019 | 0.007 | 0.001 |
| pseudovirus | D614G | NT | 0.008 | NT |
| pseudovirus | B.1.351 | - | 0.14 | 3.07 |
| pseudovirus | B.1.427 | 0.49 | - | - |
| pseudovirus | B.1.429 | - | - | - |
| pseudovirus | B.1.1.7 | - | <0.05 | <0.05 |
| pseudovirus | B.1.617 | 0.09 | - | - |
| BSL-3 Live virus | USA-WA1/2020 (NR-52281) strain | 0.4 | <0.16 | <0.16 |
- : non-neutralizing
NT : not tested
µg/mL
FIG. 11F

Binding of RBT-0813 to FcγR2a (Allelic variant R167)

| Cell Culture Step | Process Step | In-Process Testing |
|---|---|---|
| 1 | Vial thaw | |
| 2 | Inoculum scale up | Viability, cell density |
| 3 | Seed cultures in 100L bioreactor | Viability, cell density |
| 4 | Production culture in 500L | Viability, cell density, product concentration<br>Unprocessed harvest bulk: Sterility, Mycoplasma, Adventitious Virus *in vitro* |
| 5 | Harvest and cell separation | Product concentration |

*FIG. 24*

| Purification Step | Process Flow | Purpose |
|---|---|---|
| 1 | Clarification | Remove cells and insoluble particle |
| 2 | Direct Product Capture (DPC) | Capture target protein and separate product from impurities |
| 3 | Low pH Hold/ Viral Inactivation | Viral inactivation |
| 4 | Polishing 1 (Bind-elute Mode) | Reduce/Remove impurities: HCPs, DNA, viruses potentially exist in product |
| 5 | Depth Filtration | Reduce/remove impurities, e.g. HCP, HMW and residual DNA. |
| 6 | Polishing 2 (Flow-through Mode) | Reduce/Remove impurities: HCPs, HMW |
| 7 | Viral Filtration (VF) | Reduce/remove viruses potentially exist in product |
| 8 | Ultra-/Diafiltration | Exchange/concentrate target protein into suitable buffer and concentration |
| 9 | Final formulation to drug substance | |

*FIG. 25*

| Container Closure System Preparation | Process Step | In-Process Tests |
|---|---|---|
| 1 | Bulk DS thaw, Pooling and Mixing | pH, protein concentration, bioburden, and endotoxin testing |
| 2 | Sterile filtration | |
| 3 – Vial wash, Sterilization for stoppers, Sterilization for caps | Filling, Stoppering, Capping | Fill weight check |
| 4 | Visual inspection, Bulk packaging, Storage | AQL |

*FIG. 26*

| | SARS-CoV-2 S1 Monomer | | | SARS-CoV-2 S Protein Trimer | | | SARS-CoV-2 S Protein Trimer (Beta B.1.351 SA) | | |
|---|---|---|---|---|---|---|---|---|---|
| | $k_a$ | $k_d$ | $K_D$ | $k_a$ | $k_d$ | $K_D$ | $k_a$ | $k_d$ | $K_D$ |
| 202-03 | 4.62E+04 | 4.80E-04 | 1.06E-08 | 3.04E+05 | 3.12E-05 | 2.96E-10 | 1.03E+05 | 1.00E-05 | 8.53E-11 |
| 339-031 | 3.10E+04 | 1.83E-04 | 5.91E-09 | 7.34E+05 | 1.00E-05* | 1.36E-11 | 1.02E+05 | 1.00E-05* | 8.80E-12 |

| | SARS-CoV-2 S Protein Trimer (Kappa B.1.617.1 India Variant) | | | SARS-CoV-2 S Protein Trimer (Delta B.1.617.2 India Variant) | | | SARS-CoV-2 S Protein Trimer (Alpha B.1.1.7 UK Variant) | | |
|---|---|---|---|---|---|---|---|---|---|
| | $k_a$ | $k_d$ | $K_D$ | $k_a$ | $k_d$ | $K_D$ | $k_a$ | $k_d$ | $K_D$ |
| 202-03 | 1.80E+05 | 4.91E-05 | 2.72E-10 | 1.36E+05 | 4.24E-05 | 3.12E-10 | 3.33E+05 | 1.06E-05 | 7.00E-11 |
| 339-031 | 3.00E+06 | 1.00E-05* | 1.00E-11 | 1.18E+05 | 9.00E-05* | 3.07E-11 | 3.25E+05 | 9.00E-05* | 1.00E-11 |

| | SARS-CoV-2 S Protein Trimer (Gamma P.1 Brazil Variant) | | |
|---|---|---|---|
| | $k_a$ | $k_d$ | $K_D$ |
| 202-03 | 1.37E+05 | 1.00E-05 | 7.33E-11 |
| 339-031 | 1.00E+06 | 1.00E-05 | 9.45E-12 |

*Value indicates off-rate is slower than limit of detection.

| ID | 339-031 | 202-03 |
|---|---|---|
| 339-031 | | 0.55 |
| 202-03 | 0.34 | |
| WA1 S Trimer | | |

B

| ID | 339-031 | 202-03 |
|---|---|---|
| 339-031 | | 0.97 |
| 202-03 | 0.13 | |
| Delta S Trimer | | |

*FIG. 31*

| Common Name/Origin | SARS-CoV-2 Spike | Mutations |
|---|---|---|
| Wuhan | Wild Type | N/A |
| D614G | D614G | D614G |
| Beta/ South Africa | B.1.351 | K417N, E484K, N501Y, D614G, A701V |
| Epsilon/ California | B.1.427 | L452R, D614G |
| Epsilon/ California | B.1.429 | S13I, W152C, L452R, D614G |
| Delta/ India | B.1.617 | L452R, E484Q |
| Alpha/ UK | B.1.1.7 / 501Y.V1 | del69–70 HV, del144 Y, N501Y, A570D, D614G, P681H, T761I, S982A, D1118H |
| Gamma/ Brazil | P.1 | L18F, T20N, P26S, D138Y, R190S, K417T, E484K, N501Y, D614G, H655Y, T1027I |

Block (110–150 / 260–300):
```
       110        120        130        140        150
        |          |          |          |          |
GGTTTCGGCAAGCCCCAGGCAAGGAACGCGAATTCGTGGCCACT
 W  F  R  Q  A  P  G  K  E  R  E  F  V  A  T
CCAAAGCCGTTCGGGGTCCGTTCCTTGCGCTTAAGCACCGGTGA
        |          |          |          |          |
       260        270        280        290        300
```

Block (410–450 / 260–300):
```
       260        270        280        290        300
        |          |          |          |          |
AGCCTGAGGACACAGCCGTCTACTATTGTGCTAGAGTGGACGG
 K  P  E  D  T  A  V  Y  Y  C  A  R  V  D  R
TCGGACTCCTGTGTCGGCAGATGATAACACGATCTCACCTGCC
        |          |          |          |          |
       410        420        430        440        450
```

Block (410–450 / 560–600):
```
       410        420        430        440        450
        |          |          |          |          |
CACCTGAACTCCTGGGGGGACCGTCAGTCTTCCTCTTCCCCCA
 A  P  E  L  L  G  G  P  S  V  F  L  F  P  P
GTGGACTTGAGGACCCCCTGGCAGTCAGAAGGAGAAGGGGGGT
        |          |          |          |          |
       560        570        580        590        600
```

Block (560–600 / 710–750):
```
       560        570        580        590        600
        |          |          |          |          |
GCGTGGAGGTGCATAATGCCAAGACAAAGCCGGGAGGAGCAG
 A  V  E  V  H  N  A  K  T  K  P  R  E  E  Q
CGCACCTCCACGTATTACGGTTCTGTTTCGGCCCTCCTCGTC
        |          |          |          |          |
       710        720        730        740        750
```

Block (710–750):
```
       710        720        730        740        750
        |          |          |          |          |
CCATCGAGAAAACCATCTCCAAAGCCAAAGGCCAGCCCGAGAA
 P  I  E  K  T  I  S  K  A  K  G  Q  P  R  E
GGTAGCTCTTTTGGTAGAGGTTTCGGTTTCCGGTCGGGCTCTT
```

FIG. 41E

| Clone ID | Culture Code | Inoculation Date | Initial Working Volume (L) | Seed Train | Initial Seed Density (x10⁶ vc/mL) | Temp. C | Basal Media | pH | Feed Strategy |
|---|---|---|---|---|---|---|---|---|---|
| 2495A-01-01 | BV04 | 15Dec2021 | 0.18 | N-2 | 1.00 ±0.20 | Initial 36.5 shift to 33.0 when the VCD reaches 10.00 – 16.00 x 10⁶ vc/mL | BM020H (Actipro) | 6.90 ± 0.20 | Day 2/4/6/8/10 at 4% |
| 2495A-01-08 | BV16 | 15Dec2021 | 0.18 | N-2 | 1.00 ±0.20 | | | | |
| 2495A-01-12 | BV17 | 15Dec2021 | 0.18 | N-2 | 1.00 ±0.20 | | | | |
| 2495A-01-14 | BV18 | 15Dec2021 | 0.18 | N-2 | 1.00 ±0.20 | | | | |
| 2495A-01-19 | BV19 | 15Dec2021 | 0.18 | N-2 | 1.00 ±0.20 | | | | |
| 2495A-01-22 | BV20 | 15Dec2021 | 0.18 | N-2 | 1.00 ±0.20 | | | | |
| 2495A-02-08 | BV21 | 15Dec2021 | 0.18 | N-2 | 1.00 ±0.20 | | | | |
| 2495A-02-09 | BV22 | 15Dec2021 | 0.18 | N-2 | 1.00 ±0.20 | | | | |
| 2495A-01-10 | BV23 | 15Dec2021 | 0.18 | N-2 | 1.00 ±0.20 | | | | |
| 2495A-02-19 | BV24 | 15Dec2021 | 0.18 | W/O | 0.40 ± 0.10 | | | | Day 3/5/7/9/11 at 3% |

*FIG. 46A*

| Clone ID | Culture | End Titer (g/L) | End Via (%) | End Lactate (g/L) | N-Glycan Man 5 (%) | SDS Caliper NR Purity (%) | SEC Monomer / HMW | cIEF G1 (%) | cIEF G2 (%) | cIEF P1 (%) | cIEF P2 (%) |
|---|---|---|---|---|---|---|---|---|---|---|---|
| 2495A-01-08 | BV16 | 4.45 | 63.8 | 0.25 | 8.1 | 98.0 | 81.3 / 18.7 | 49.6 | 13.6 | 17.1 | 19.7 |
| 2495A-02-08 | BV21 | 5.12 | 75.0 | 0.58 | 7.7 | 98.4 | 77.2 / 22.8 | 39.9 | 17.8 | 16.5 | 25.8 |

FIG. 46B

| Clone ID | Culture | HPLC Titer (g/L) | End Via (%) | End Lactate (g/L) | N-Glycan Man 5 (%) | SDS Caliper NR Purity (%) | SEC Monomer / HMW | cIEF G1 (%) | cIEF G2 (%) | cIEF P1 (%) | cIEF P2 (%) |
|---|---|---|---|---|---|---|---|---|---|---|---|
| 2495A-01-08 | FU54-3 L2× round | 3.51 | 89.0 | 0.11 | 6.7 | 97.2 | 86.1 / 13.9 | 49.9 | 13.9 | 16.2 | 20.0 |

FIG. 46C

| Test Item | Release Acceptance Criteria | Shelf-Life Acceptance Criteria |
|---|---|---|
| Identification | | |
| Identification by iCIEF | Conforms to Reference Standard | N/A |
| Physical Properties | | |
| Clarity | ≤ 30.0 NTU | ≤ 30.0 NTU |
| Color | Not more colored than No.3 standard solution (Refer to EP) | Not more colored than No. 3 Standard Solution (Refer to EP) |
| Osmolality | 253 mOsmol/kg - 353 mOsmol/kg | N/A |
| pH | 7.5 - 8.5 | 7.5 - 8.5 |
| Content | | |
| Protein Concentration | 22.5 mg/mL - 27.5 mg/mL | 22.5 mg/mL - 27.5 mg/mL |
| Potency | | |
| ELISA Binding | 60% -140 % relative potency | 60 % -140 % relative potency |
| Purity | | |
| Charge Variants Purity by iCIEF | Group 1% ≤ 60.0%; Peak 1% ≤ 25.0%; Peak 2% ≥ 10.0%; Group 2% ≤ 20.0% | Group 1% ≤ 60.0%; Peak 1% ≤ 25.0%; Peak 2% ≥ 10.0%; Group 2% ≤ 20.0% |
| Purity by SEC | Monomer% (Main Peak%) ≥ 92.0%; HMWS% ≤ 8.0%; LMWS%: Report Result | Monomer% (Main Peak%) ≥ 90.0%; HMWS% ≤ 10.0%; LMWS%: Report Result |
| Purity by CE-SDS (Reduced) | Purity% (Main Peak%) ≥ 90.0%; Total Minor Species%: Report Result | Purity% (Main Peak%) ≥ 90.0%; Total Minor Species%: Report Result |
| Purity by CE-SDS (Non-reduced) | Purity% (Main Peak%) ≥ 90.0%; Total Pre-peaks%: Report Result | Purity% (Main Peak%) ≥ 90.0%; Total Pre-peaks%: Report Result |
| Impurity | | |
| Residual DNA | ≤ 7.0 pg/mg | N/A |
| Residual Host Cell Protein | ≤ 300 ng/mg | N/A |
| Residual Protein A | ≤ 50 ng/mg | N/A |
| Safety | | |
| Bioburden | ≤ 3 CFU/30 mL | N/A |
| Bacterial Endotoxins | ≤ 0.25 EU/mg | N/A |

*FIG. 47*

| Group # | No. of SD Rats (#/ gender) | | Treatment | | | | | Dose Route | Dose Frequency |
|---|---|---|---|---|---|---|---|---|---|
| | Male | Female | WBP2495 | Dose (mg/kg) | Conc. (mg/mL) | Dose Volume (mL/kg) | Vehicle | | |
| 1 | 6 | 6 | WBP2495 | 30 | 15 | 2 | WBP2495 Placebo | IV infusion (1h) | Single |
| 3 | 6 | 6 | WBP2495 | 30 | 15 | 2 | WBP2495 Placebo | SC | Single |

Note: Animals will be fed before dosing

*FIG. 48A*

| Groups | Matrix | Detect factor | Blood Volume | Serum Volume | Dose Route | Time-points |
|---|---|---|---|---|---|---|
| 1 | Serum | PK | 0.3 mL | 100 μL | IV infusion (1h) | Pre-dose, 1h* (Day 1), 2h (Day 1), 4h (Day 1), 8h (Day 1), 24h (Day 2), 48h (Day 3), 96h (Day 5), 168h (Day 8), 240h (Day 11), 336h (Day 15), 504h (Day 22), 696h (Day 30), 864h (Day 37), 1032h (Day 44) |
| | Serum | ADA | 0.45 mL | 150 μL | | Pre-dose, 504h (Day 22), 696h (Day 30), 1032h (Day 44) |
| 2 | Serum | PK | 0.3 mL | 100 μL | SC | Pre-dose, 1h* (Day 1), 2h (Day 1), 4h (Day 1), 8h (Day 1), 24h (Day 2), 48h (Day 3), 96h (Day 5), 168h (Day 8), 240h (Day 11), 336h (Day 15), 504h (Day 22), 696h (Day 30), 864h (Day 37), 1032h (Day 44) |
| | Serum | ADA | 0.45 mL | 150 μL | | Pre-dose, 504h (Day 22), 696h (Day 30), 1032h (Day 44) |

Note:
1) Day 1 is the first day of dosing. All timepoints are after the start of dosing.
2) *Sampling immediately after 1 h IV infusion was finished.
3) Predose is at 0 h before dosing.

| Chain A:D (spike : VHH N-term Ab) | | | Chain B:D (spike : VHH N-term Ab) | | |
|---|---|---|---|---|---|
| interface area [Å²] | 913.1 | | interface area [Å²] | 295.0 | |
| Hydrogen bonds | | | | | |
| Chain A | Distance [Å] | Chain D | Chain B | Distance [Å] | Chain D |
| A:THR 470 [OG1] | 3.29 | D:SER 32 [O] | B:ASN 164 [OD1] | 3.16 | D:THR 28 [N] |
| A:THR 470 [N] | 3.60 | D:SER 32 [OG] | B:NAG1000 [O3] | 2.90 | D:TYR 54 [OH] |
| A:THR 470 [OG1] | 2.87 | D:SER 32 [OG] | | | |
| A:ASN 481 [N] | 3.22 | D:TYR 59 [O] | | | |
| A:ARG 466 [NH2] | 2.73 | D:ARG 100 [O] | | | |
| A:ARG 346 [NH1] | 2.91 | D:ASP 103 [O] | | | |
| A:ASN 450 [O] | 2.66 | D:TRP 105 [NE1] | | | |
| A:ASN 450 [OD1] | 2.78 | D:ARG 45 [NH2] | | | |
| A:ILE 468 [O] | 3.46 | D:TRP 33 [N] | | | |
| A:THR 470 [O] | 2.81 | D:ASN 58 [ND2] | | | |
| A:GLU 471 [OE2] | 2.78 | D:ASN 58 [ND2] | | | |
| A:ASN 481 [OD1] | 3.61 | D:ASP 61 [N] | | | |

*FIG. 53B*

| [E2.3] Comparison to mutagenesis studies | | |
|---|---|---|
| Residues identified in mutagenesis studies | Confirmed by structural study | Unconfirmed by structural study |
| A: ASN 450 | A: ASN 450 | A: ILE 472 |
| A: ILE 472 | A: PHE 490 | |
| A: PHE 490 | | |

FIG. 53C

MFVFLVLLPL VSSQCVNLTT RTQLPPAY...

...PGE VFNAT... V...

...

CVADYSVLYN SASFSTFKCY GVSPTKLNDL CFTNVYADSF VIRGDEVRQI APGQTGKIAD

YNYKLPDDFT GCVIAWNSNN LDS...VGG... ...RFKKSN LKPFE...D...YQAGST...

...Q...C...YQPGQT NGVGYQPYRV VVLSFELLHA PATVCG PKKS TNLVKNKCVN

FNFNGLTGTG VLTESNKKFL PFQQFGRDIA DTTDAVRDPQ TLEILDITPC SFGGVSVITP

GTNTSNQVAV LYQDVNCTEV PVAIHADQLT PTWRVYSTGS NVFQTRAGCL IGAEHVNNSY

ECDIPIGASI CASYQTQTNS PRRARSVASQ SIIAYTMSLG AENSVAYSNN SIAIPTNFTI

SVTTEILPVS MTKTSVDCTM YICGDSTECS NLLLQYGSFC TQLNRALTGI AVEQDKNTQE

VFAQVKQIYK TPPIKDFGGF NFSQILPDPS KPSKRSFIED LLFNKVTLAD AGFIKQYGDC

LGDIAARDLI CAQKFNGLTV LPPLLTDEMI AQYTSALLAG TITSGWTFGA GAALQIPFAM

QMAYRFNGIG VTQNVLYENQ KLIANQFNSA IGKIQDSLSS TASALGKLQD VVNQNAQALN

TLVKQLSSNF GAISSVLNDI LSRLDKVEAE VQIDRLITGR LQSLQTYVTQ QLIRAAEIRA

SANLAATKMS ECVLGQSKRV DFCGKGYHLM SFPQSAPHGV VFLHVTYVPA QEKNFTTAPA

ICHDGKAHFP REGVFVSNGT HWFVTQRNFY EPQI

| Chain B : D (spike : VHH N-term Ab) | | | Chain C : D (spike : VHH N-term Ab) | |
|---|---|---|---|---|
| Potentially interacting residues | Residues within 5Å around Ab | Potentially interacting residues | Potentially interacting residues | Potentially interacting residues |
| B : ALA 344 | B : ARG 346 | D : SER 32 | | |
| B : ARG 346 | B : PHE 347 | D : TRP 33 | | |
| B : PHE 347 | B : ALA 348 | D : PHE 37 | | |
| B : ALA 348 | B : SER 349 | D : GLN 39 | | |
| B : SER 349 | B : TYR 351 | D : LYS 43 | | |
| B : TYR 351 | B : ALA 352 | D : GLU 44 | | |
| B : ALA 352 | B : TRP 353 | D : ARG 45 | | |
| B : ASN 354 | B : ASN 354 | D : PHE 47 | | |
| B : ARG 355 | B : ARG 355 | D : THR 50 | | |
| B : LYS 356 | B : LYS 356 | D : ILE 51 | | |
| B : SER 399 | B : SER 399 | D : ASN 52 | | |
| B : TYR 449 | B : TYR 449 | D : GLU 53 | | |
| B : ASN 450 | B : ASN 450 | D : GLY 55 | | |
| B : LEU 452 | B : LEU 452 | D : ARG 57 | | |
| B : ARG 466 | B : ARG 466 | D : ASN 58 | | |
| B : ILE 468 | B : ILE 468 | D : TYR 59 | | |
| B : SER 469 | B : THR 470 | D : ALA 60 | | |
| B : THR 470 | B : GLU 471 | D : ASP 61 | | |
| B : GLU 471 | B : ILE 472 | D : SER 62 | | |
| B : ILE 472 | B : PRO 479 | D : TYR 64 | | |
| B : PRO 479 | B : CYS 480 | D : VAL 98 | | |
| B : CYS 480 | B : ASN 481 | D : ASP 99 | | |
| B : ASN 481 | B : PHE 490 | D : ARG 100 | | |
| B : PHE 490 | B : LEU 492 | D : ASP 101 | | |
| B : LEU 492 | B : SER 494 | D : PHE 102 | | |
| B : SER 494 | | D : ASP 103 | | |
| | | D : TYR 104 | | |
| | | D : TRP 105 | | |

*FIG. 57A*

| Chain B:D (spike : VHH N-term Ab) | | | Chain C:D (spike : VHH N-term Ab) | | |
|---|---|---|---|---|---|
| interface area [Å²] | 918.9 | | | | |
| Hydrogen bonds | | | Hydrogen bonds | | |
| Chain B | Distance [Å] | Chain D | Chain C | Distance [Å] | Chain D |
| B:ARG 346 [ NE ] | 2.90 | D:ASP 103 [ O ] | | | |
| B:ARG 346 [ NH1] | 2.86 | D:ASP 103 [OD1] | | | |
| B:SER 349 [ N ] | 2.90 | D:ASP 103 [OD1] | | | |
| B:ARG 466 [ NH1] | 2.90 | D:ASP 99 [ O ] | | | |
| B:ARG 466 [ NH1] | 2.65 | D:ASP 101 [ O ] | | | |
| B:THR 470 [ OG1] | 2.83 | D:ASN 58 [OD1] | | | |
| B:ASN 481 [ N ] | 2.98 | D:TYR 59 [ O ] | | | |
| B:ASN 481 [ ND2] | 3.06 | D:TYR 59 [ O ] | | | |
| B:TYR 449 [ O ] | 2.82 | D:ARG 45 [ NH2] | | | |
| B:ASN 450 [ O ] | 3.74 | D:TRP 105 [ NE1] | | | |
| B:ASN 450 [ OD1] | 2.91 | D:ARG 45 [ NH2] | | | |
| B:PRO 479 [ O ] | 3.06 | D:TYR 59 [ N ] | | | |
| B:ASN 481 [ O ] | 2.89 | D:ASP 61 [ N ] | | | |
| Salt bridges | | | Salt bridges | | |
| Chain B | distance[Å] | Chain D | | | |
| B:ARG 346 [ NH1] | 3.53 | D:ASP 103 [OD2] | | | |
| B:ARG 346 [ NH1] | 2.86 | D:ASP 103 [OD1] | | | |

FIG. 57B

| Residues identified in mutagenesis studies | Confirmed by structural study | Rejected by structural study |
|---|---|---|
| A: ASN 450 | A: ASN 450 | |
| A: ILE 472 | A: PHE 490 | |
| A: PHE 490 | A: ILE 472 | |

FIG. 57C

```
                    Interacting residues from mutagenesis studies
         10         20         30         40         50         60
MFVFLVLLPL VSSQCVNLTT RTQLPPAY... ... ... ...

70         80         90        100        110        120
... ... ... ... ... ...

130        140        150        160        170        180
... ... ... ... ... ...

190        200        210        220        230        240
... ... ... ... ... ...

250        260        270        280        290        300
... ... ... ... ... ...

310        320        330        340        350        360
... ... ... ... ... PGE VFN... ... ... ...

370        380        390        400        410        420
CVADYSVLYN SASFSTFKCY GVSPTKLNDL CFTNVYAD?F VRGDEVRQI APGQTGKIAD 430        440        450        460        470        480
YNYKLPDDFT GCVIAWNSNN LDSKVGGNYN YLYRLFRKSN LKPFERDIST EIYQAGS...

490        500        510        520        530        540
...GVEGFNCYF P...E...GFQPT NGVGYQPYRV VVLSFELLHA PATVCG PFKS TNLVKNKCVN 550        560        570        580        590        600
FNFNGLTGTG VLTESNKKFL PFQQFGRDIA DTTDAVRDPQ TLEILDITPC SFGGVSVITP 610        620        630        640        650        660
GTNTSNQVAV LYQDVNCTEV PVAIHADQLT PTWRVYSTGS NVFQTRAGCL IGAEHVNNSY 670        680        690        700        710        720
ECDIPIGAGI CASYQTQTNS PRRARSVASQ SIIAYTMSLG AENSVAYSNN SIAIPTNFTI 730        740        750        760        770        780
SVTTEILPVS MTKTSVDCTM YICGDSTECS NLLLQYGSFC TQLNRALTGI AVEQDKNTQE 790        800        810        820        830        840
VFAQVKQIYK TPPIKDFGGF NFSQILPDPS KPSKRSFIED LLFNKVTLAD AGFIKQYGDC 850        860        870        880        890        900
LGDIAARDLI CAQKFNGLTV LPPLLTDEMI AQYTSALLAG TITSGWTFGA GAALQIPFAM 910        920        930        940        950        960
QMAYRFNGIG VTQNVLYENQ KLIANQFNSA IGKIQDSLSS TASALGKLQD VVNQNAQALN 970        980        990       1000       1010       1020
TLVKQLSSNF GAISSVLNDI LSRLDKVEAE VQIDRLITGR LQSLQTYVTQ QLIRAAEIRA 1030       1040       1050       1060       1070       1080
SANLAATKMS ECVLGQSKRV DFCGKGYHLM SFPQSAPHGV VFLHVTYVPA QEKNFTTAPA 1090       1100       1110       1120       1130       1140
ICHDGKAHFP REGVFVSNGT HWFVTQRNFY EPQIITTDNT FVSGNCDVVI GIVNNTVYDP 1150       1160       1170       1180       1190       1200
LQPELDSFKE ELDKYFKNHT SPDVDLGDIS GINASVVNIQ KEIDRLNEVA KNLNESLIDL 1210       1220       1230       1240       1250       1260
QELGKYEQYI KWPWYIWLGF IAGLIAIVMV TIMLCCMTSC CSCLKGCCSC GSCCKFDEDD

1270
SEPVLKGVKL HYT
```

*FIG. 58*

| Epitope description | | | Paratope description | | |
|---|---|---|---|---|---|
| Chain A epitope 1 : chain B epitope 2 | | | Chain D epitope 1 : chain D epitope 2 | | |
| Unique spike residues at epitope 1 | Shared spike residues at epitopes 1 and 2 | Unique spike residues at epitope 2 | Unique VHH residues at epitope 1 | Shared VHH residues at epitopes 1 and 2 | Unique VHH residues at epitope 2 |
| A : TRP 353 | A : ARG 346 | B : ALA 344 | D : PRO 31 | D : SER 32 | D : ILE 51 |
| A : LYS 444 | A : PHE 347 | B : SER 399 | D : LYS 64 | D : TRP 33 | D : ASN 52 |
| A : GLY 482 | A : ALA 348 | B : ILE 472 | D : ALA 96 | D : PHE 37 | D : GLU 53 |
| A : VAL 483 | A : SER 349 | | | D : GLN 39 | D : GLY 56 |
| A : CYS 488 | A : TYR 351 | | | D : LYS 43 | D : SER 82 |
| | A : ALA 352 | | | D : GLU 44 | D : TYR 94 |
| | A : ASN 354 | | | D : ARG 45 | |
| | A : ARG 355 | | | D : PHE 47 | |
| | A : LYS 356 | | | D : THR 50 | |
| | A : LYS 444 | | | D : ARG 57 | |
| | A : TYR 449 | | | D : ASN 58 | |
| | A : ASN 450 | | | D : TYR 59 | |
| | A : LEU 452 | | | D : ALA 60 | |
| | A : ARG 466 | | | D : ASP 61 | |
| | A : ILE 468 | | | D : VAL 66 | |
| | A : SER 469 | | | D : ASP 98 | |
| | A : THR 470 | | | D : ARG 100 | |
| | A : GLU 471 | | | D : ASP 101 | |
| | A : PRO 479 | | | D : PHE 102 | |
| | A : CYS 480 | | | D : ASP 103 | |
| | A : ASN 481 | | | D : TYR 104 | |
| | A : LEU 482 | | | D : TRP 105 | |
| | A : SER 494 | | | | |

*FIG. 61*

METHODS AND COMPOSITIONS RELATING TO COVID ANTIBODY EPITOPES

CROSS REFERENCE

This application claims the benefit of U.S. Provisional Patent Application No. 63/213,627, filed on Jun. 22, 2021, which is incorporated by reference in its entirety.

SEQUENCE LISTING

The instant application contains a Sequence Listing which has been submitted electronically in ASCII format and is hereby incorporated by reference in its entirety. Said ASCII copy, created on Aug. 17, 2022, is named 44854-830_201_SL.txt and is 1,448,782 bytes in size.

BACKGROUND

Coronaviruses like severe acute respiratory coronavirus 2 (SARS-CoV-2) can cause severe respiratory problems. Therapies are needed for treating and preventing viral infection caused by coronaviruses like SARS-CoV-2. Antibodies possess the capability to bind with high specificity and affinity to biological targets. However, the design of therapeutic antibodies is challenging due to balancing of immunological effects with efficacy. Thus, there is a need to develop compositions and methods for the optimization of antibody properties in order to develop effective therapies for treating coronavirus infections.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF SUMMARY

Provided herein are antibodies that bind to a region consisting of amino acids 380 to 430 of SARS-Cov-2 S receptor binding domain (RBD). Further provided herein are antibodies, wherein the antibody binds one, two, three, or four residues of V382, S383, P384, or T430. Further provided herein are antibodies, wherein the antibody binds to at least V382. Further provided herein are antibodies, wherein the antibody binds to at least S383. Further provided herein are antibodies, wherein the antibody binds to at least P384. Further provided herein are antibodies, wherein the antibody binds to at least T430. Further provided herein are antibodies, wherein the antibody binds to all residues of the following residues: V382, S383, P384, or T430. Further provided herein are antibodies, wherein the antibody binds one or two residues K378 or P384. Further provided herein are antibodies, wherein the antibody binds to at least K378. Further provided herein are antibodies, wherein the antibody binds to at least P384. Further provided herein are antibodies, wherein the antibody binds K378 and P384.

Provided herein are antibodies that bind to a region consisting of amino acids 100 to 300 of SARS-Cov-2 S receptor binding domain (RBD). Further provided herein are antibodies, wherein the antibody binds one, two, three, four, five, six, seven, or eight residues of R102, N125, F157, S172, F175, L176, R190, and Y265. Further provided herein are antibodies, wherein the antibody binds to at least R102. Further provided herein are antibodies, wherein the antibody binds to at least N125. Further provided herein are antibodies, wherein the antibody binds to at least F157. Further provided herein are antibodies, wherein the antibody binds to at least 5172. Further provided herein are antibodies, wherein the antibody binds to at least F175. Further provided herein are antibodies, wherein the antibody binds to at least L176. Further provided herein are antibodies, wherein the antibody binds to at least R190. Further provided herein are antibodies, wherein the antibody binds to at least Y265. Further provided herein are antibodies, wherein the antibody binds to all residues of the following residues: R102, N125, F157, S172, F175, L176, R190, and Y265.

Provided herein are antibodies that bind to a region consisting of amino acids 400 to 500 of SARS-Cov-2 S receptor binding domain (RBD). Further provided herein are antibodies, wherein the antibody binds to one, two, three, four, five, or six residues of K417, F456, G476, F486, N487, or Y489. Further provided herein are antibodies, wherein the antibody binds to at least K417. Further provided herein are antibodies, wherein the antibody binds to at least F456. Further provided herein are antibodies, wherein the antibody binds to at least G476. Further provided herein are antibodies, wherein the antibody binds to at least F486. Further provided herein are antibodies, wherein the antibody binds to at least N487. Further provided herein are antibodies, wherein the antibody binds to at least Y489. Further provided herein are antibodies, wherein the antibody binds to all residues of the following residues: K417, F456, G476, F486, N487, or Y489. Further provided herein are antibodies, wherein the antibody binds to one, two, or three residues of N450, 1472, or F490. Further provided herein are antibodies, wherein the antibody binds to at least N450. Further provided herein are antibodies, wherein the antibody binds to at least 1472. Further provided herein are antibodies, wherein the antibody binds to at least F490. Further provided herein are antibodies, wherein the antibody binds to all residues of the following residues: N450, 1472, or F490. Further provided herein are antibodies, wherein the antibody binds to one, two, or three residues of L452, 1468, or F490. Further provided herein are antibodies, wherein the antibody binds to at least L452. Further provided herein are antibodies, wherein the antibody binds to at least 1468. Further provided herein are antibodies, wherein the antibody binds to all residues of the following residues: L452, 1468, or F490.

Provided herein are antibodies that bind to a region consisting of amino acids 300 to 600 of SARS-Cov-2 S receptor binding domain (RBD). Further provided herein are antibodies, wherein the antibody binds to one, two, three, four, five, six, seven, eight, nine, or then residues of I326, R328, T531, N532, L533, F543, L552, S555, F559, or F562. Further provided herein are antibodies, wherein the antibody binds to at least 1326. Further provided herein are antibodies, wherein the antibody binds to at least R328. Further provided herein are antibodies, wherein the antibody binds to at least T531. Further provided herein are antibodies, wherein the antibody binds to at least N532. Further provided herein are antibodies, wherein the antibody binds to at least L533. Further provided herein are antibodies, wherein the antibody binds to at least F543. Further provided herein are antibodies, wherein the antibody binds to at least L552. Further provided herein are antibodies, wherein the antibody binds to at least S555. Further provided herein are antibodies, wherein the antibody binds to at least F559. Further provided herein are antibodies, wherein the antibody binds to at F562. Further provided herein are antibodies, wherein the antibody binds to all residues of the following residues: I326, R328, T531, N532, L533, F543, L552, S555, F559, or F562.

Provided herein are bispecific antibodies for use in treatment of SARS-CoV-2. Further provided herein are bispecific antibodies with at least 90% similarity to SEQ ID NO: 2670. Further provided herein are bispecific antibodies with at least 95% similarity to SEQ ID NO: 2670. Further provided herein are bispecific antibodies which have a sequence of SEQ ID NO: 2670. Further provided herein are bispecific antibodies which are derived from the sequence at least 90% similar to SEQ ID NO: 2669. Further provided herein are bispecific antibodies which are derived from the sequence at least 95% similar to SEQ ID NO: 2669. Further provided herein are bispecific antibodies which are derived from the sequence of SEQ ID NO: 2669.

Provided herein is a method of treating SARS-CoV-2, the method comprising administering an antibody to a subject wherein the antibody is at least 90% similar to SEQ ID NO: 2670.

BRIEF DESCRIPTION OF THE DRAWINGS

The patent or application file contains at least one drawing executed in color. Copies of this patent or patent application publication with color drawings(s) will be provided by the Office upon request and payment of the necessary fee.

FIG. 7A illustrates solvent-accessible surface representation of spike protein trimer in closed (PDB: 6VXX) and open (PDB: 6VSB) conformations. VHH nanobodies (Antibody 5, Antibody 6) binding sites overlap with that of ACE2 in both conformations, while Antibody 1 and Antibody 2 IgGs access a more occluded region. FIG. 7B illustrates cartoon representations of SARS-CoV-2 S protein receptor binding domain (RBD) with critical residues highlighted as spheres for each monoclonal antibody. FIG. 7C illustrates negative-staining electron microscopy analysis which shows the distinct binding regions of antibodies identified from the distinct antibody libraries utilized in this study (colored surface). The SARS-CoV-2 spike protein N-terminal domain (NTD), C-terminal domain (CTD), RBD, and bound ACE2 are shown as cartoon representations.

FIG. 8 illustrates tables showing which mutations are located at the receptor binding domain (RBD). These mutations include G22813T, G23012A, A23063T, A23403g, K417N, E484K, N501Y, D641G for the 501Y.V2 variant (S. African), and A23063T and N501Y for the B.1.1.7, 501Y.V1 variant (UK).

FIGS. 9A-9B illustrate SPR kinetics measured for SARS-COV-2 variant antibodies 6-3 and 6-63 against different SARS-COV-2 variant strains.

FIG. 10 illustrate IC50 data of neutralizing antibodies against pseudoviruses with single mutations relative to the G614-parent virus was tested.

FIGS. 11A-11F illustrate neutralization data of 1-12, 6-3 and 6-63 measured against single mutations and variant pseudovirus strains such as strain alpha (FIG. 11A), strain beta (FIG. 11B), strain delta (FIG. 11C), strain epsilon (B.1,427) (FIG. 11D), and strain epsilon (B.1.429) (FIG. 11E). FIG. 11F shows IC50s of variant antibodies against several variant strains.

and spike RBD (highlighted portion of the legend) for a robust S/N of binding are indicated.

Figure 22:
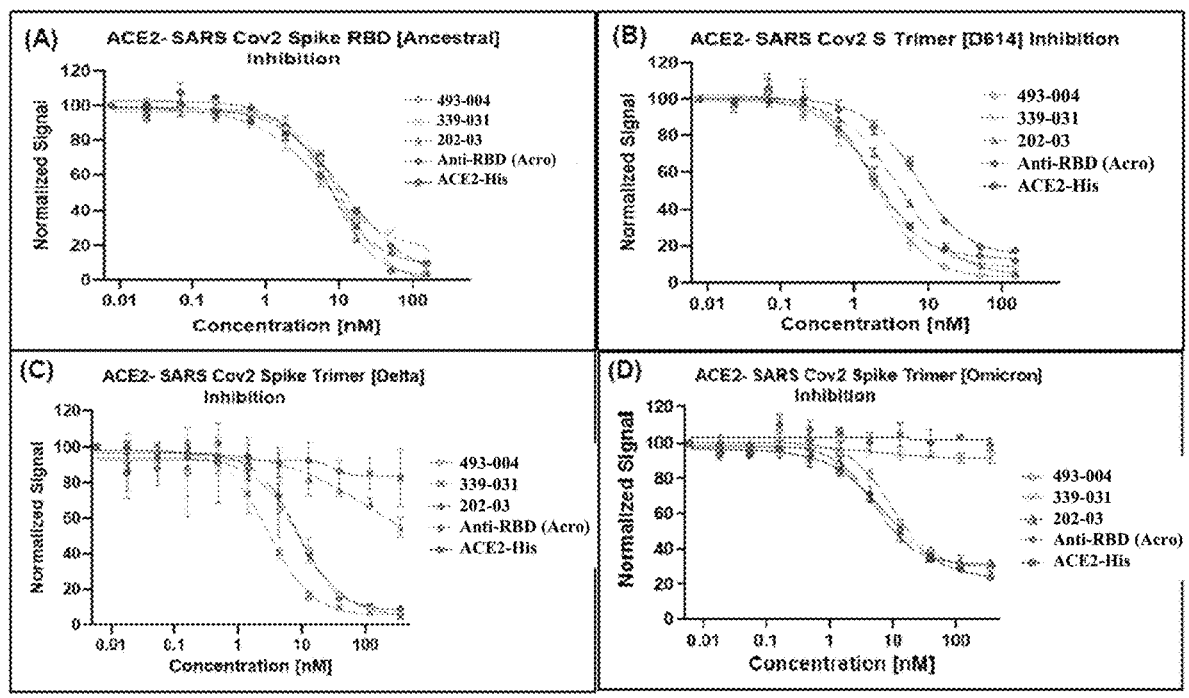

FIG. 22 shows dose dependent inhibition of ACE2-muFc/SARS-CoV-2 Spike protein interactions by antibody 493-004 and Controls (indicated in the legends). The SARS-CoV-2 Spike proteins used in these assays were (Panel A) RBD (Ancestral), (Panel B) Trimer (D614), (Panel C) Trimer (Delta), and (Panel D) Trimer (Omicron).

Figure 23:
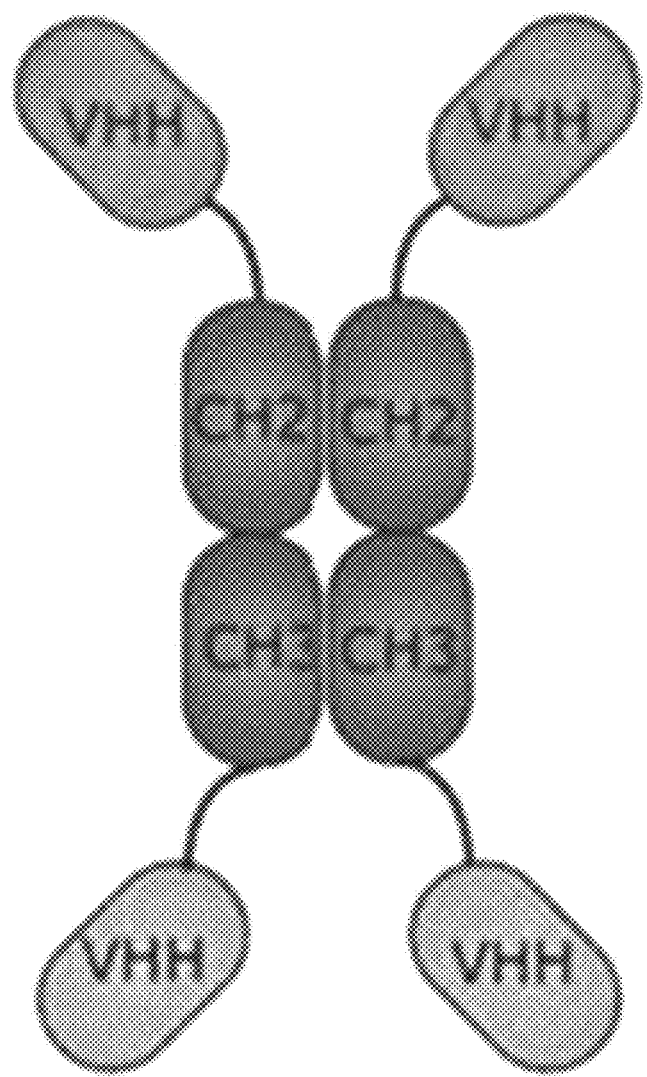

FIG. 23 depicts a schematic of the bispecific monoclonal antibody 493-004 which is constructed with two individual, single domain VHH antibodies: antibody 202-03 (top VHH domains) and antibody 339-031 (bottom VHH domains) linked together with the constant heavy chain 2 (CH2) and the constant heavy chain 3 (CH3) Fc regions of the antibody.

FIG. 24 depicts a schematic representation of the upstream manufacturing process of antibody 493-004 antibodies.

FIG. 25 depicts a schematic representation of the downstream manufacturing process of antibody 493-004 antibodies.

FIG. 26 depicts a flow diagram of the drug product process.

Figure 27A:
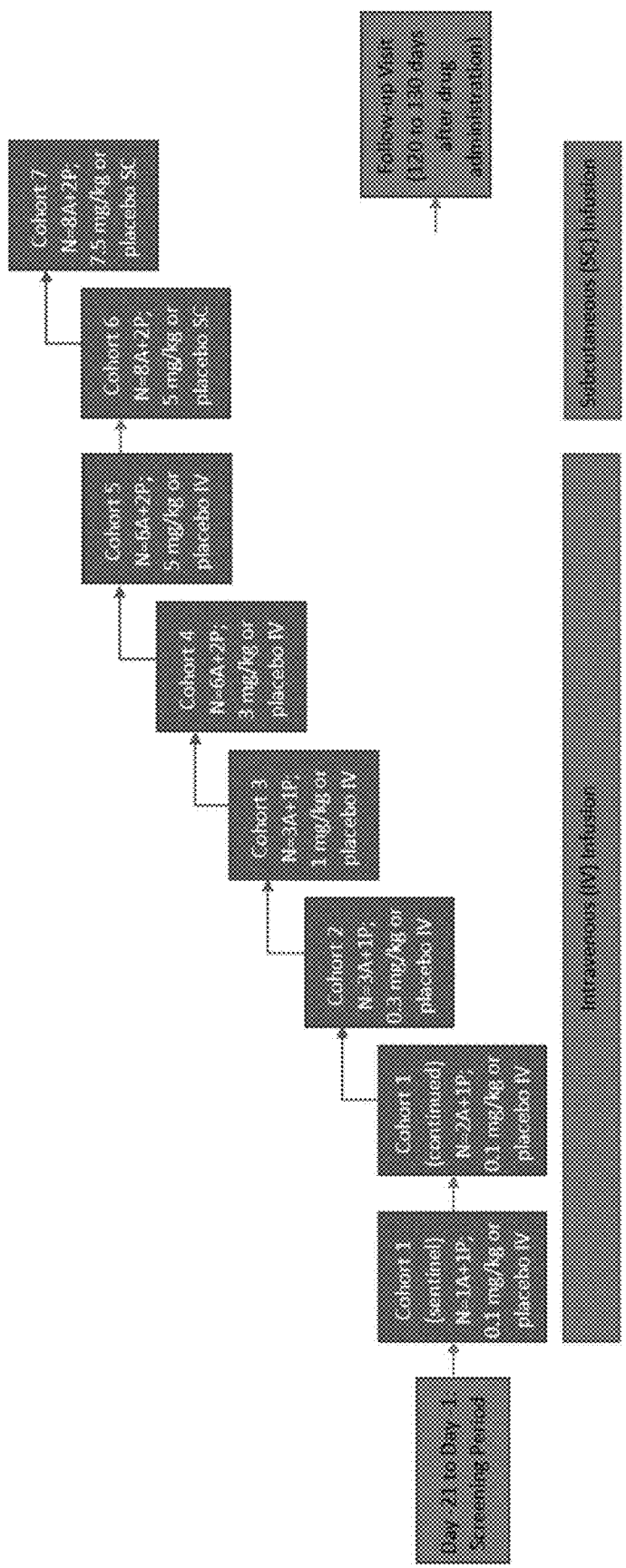

FIG. 27A depicts a schematic design of a Phase 1 clinical trial in humans.

Figure 27B:
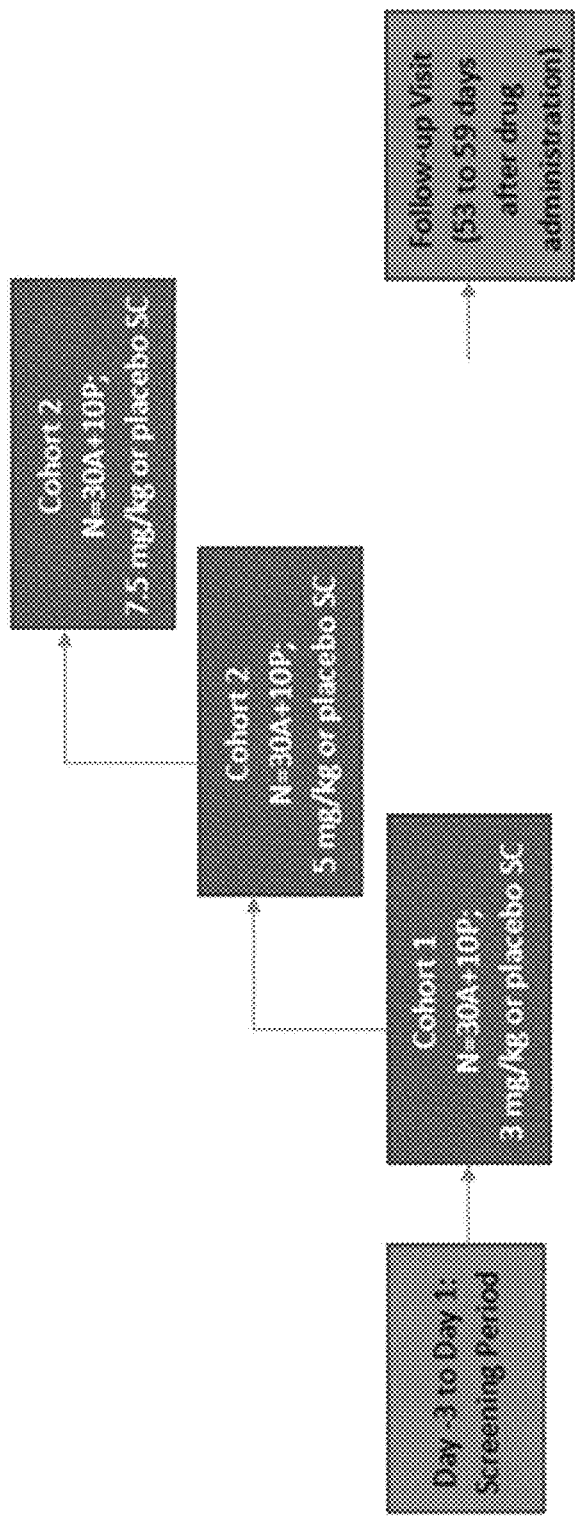

FIG. 27B depicts an schematic design of a Phase 2A clinical trial in humans.

Figure 28:
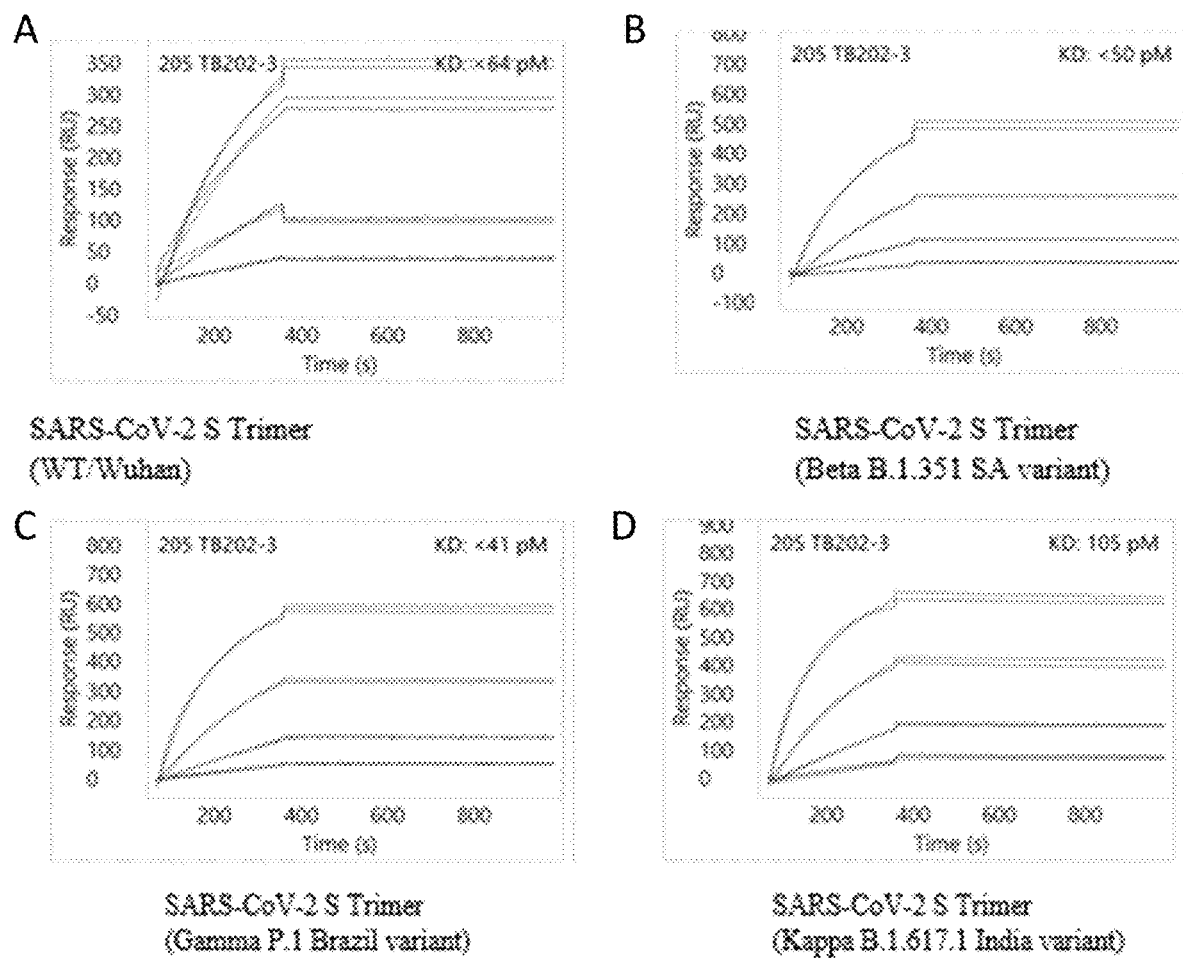

FIG. 28 depicts VHH antibody 202-03 in SPR Assays with SARS-CoV-2 variants of concern. Panel A shows the wildtype variant, Panel B shows the beta variant, Panel C shows the gamma variant, and Panel D shows the kappa variant. 339-031 demonstrated a higher apparent binding affinity for variants containing the L452R mutation (e.g., Delta and Kappa), compared to the initial 202-03 VHH antibody.

Figure 29A:
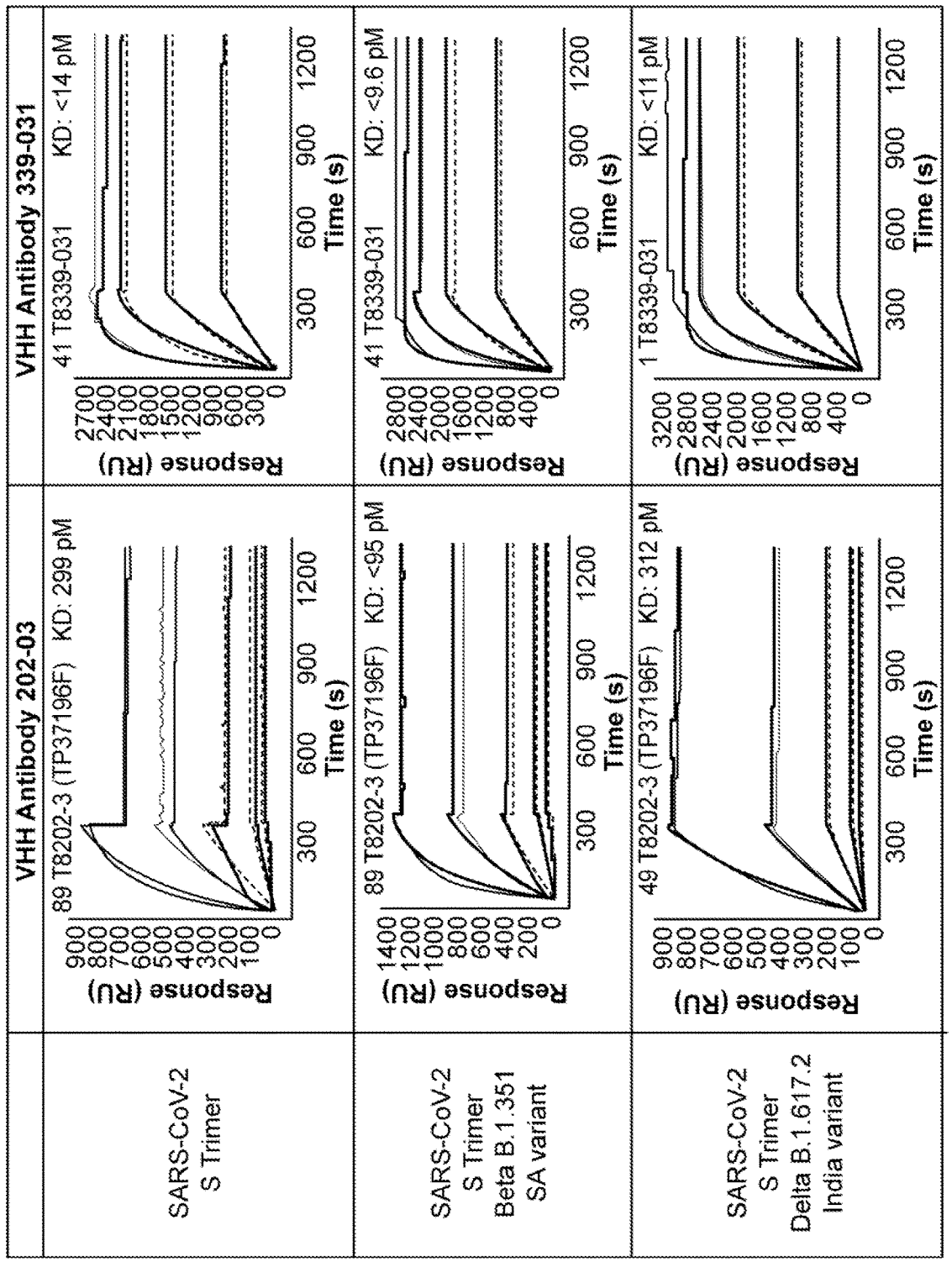
Figure 29B:
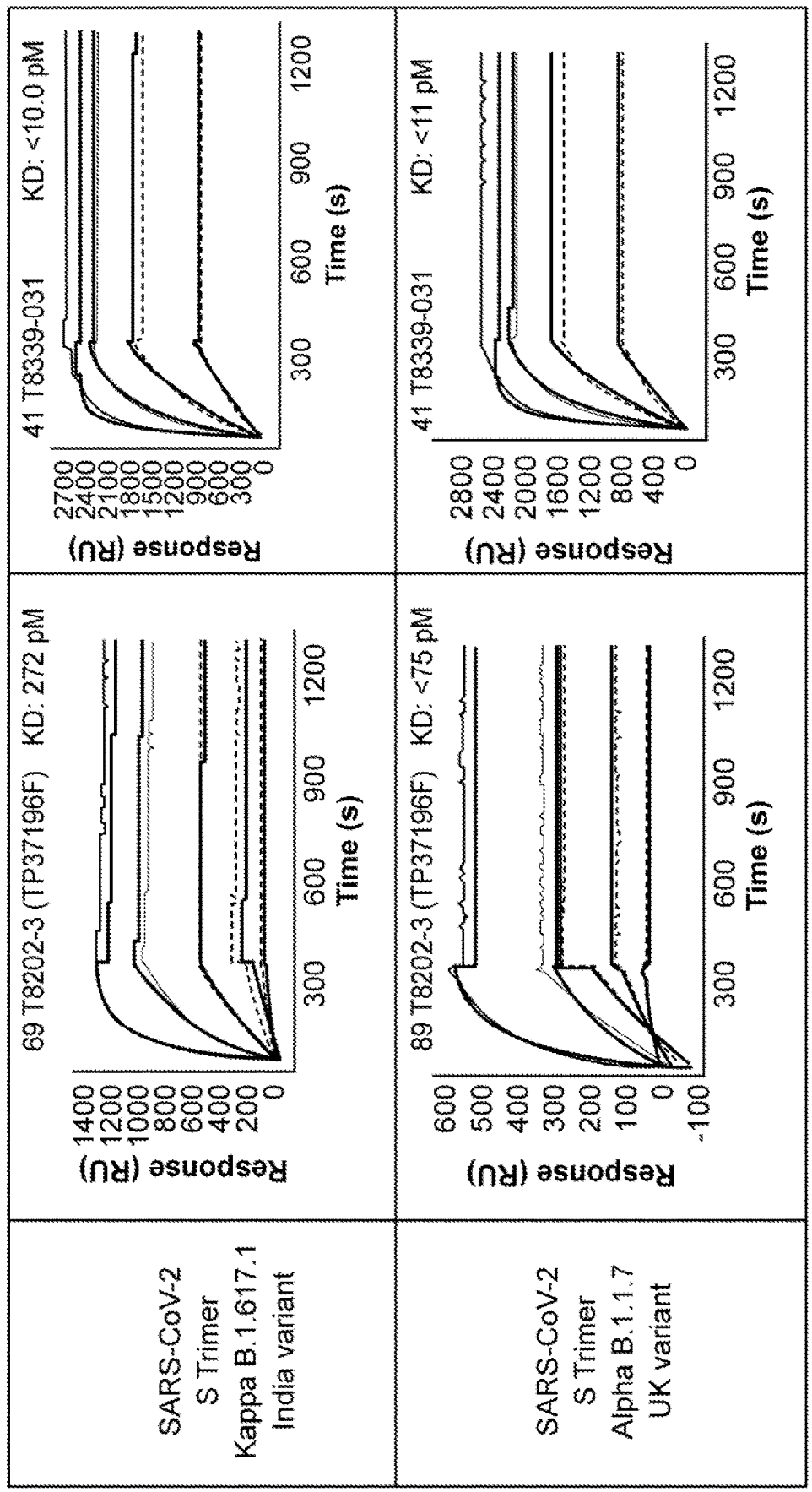
Figure 29C:
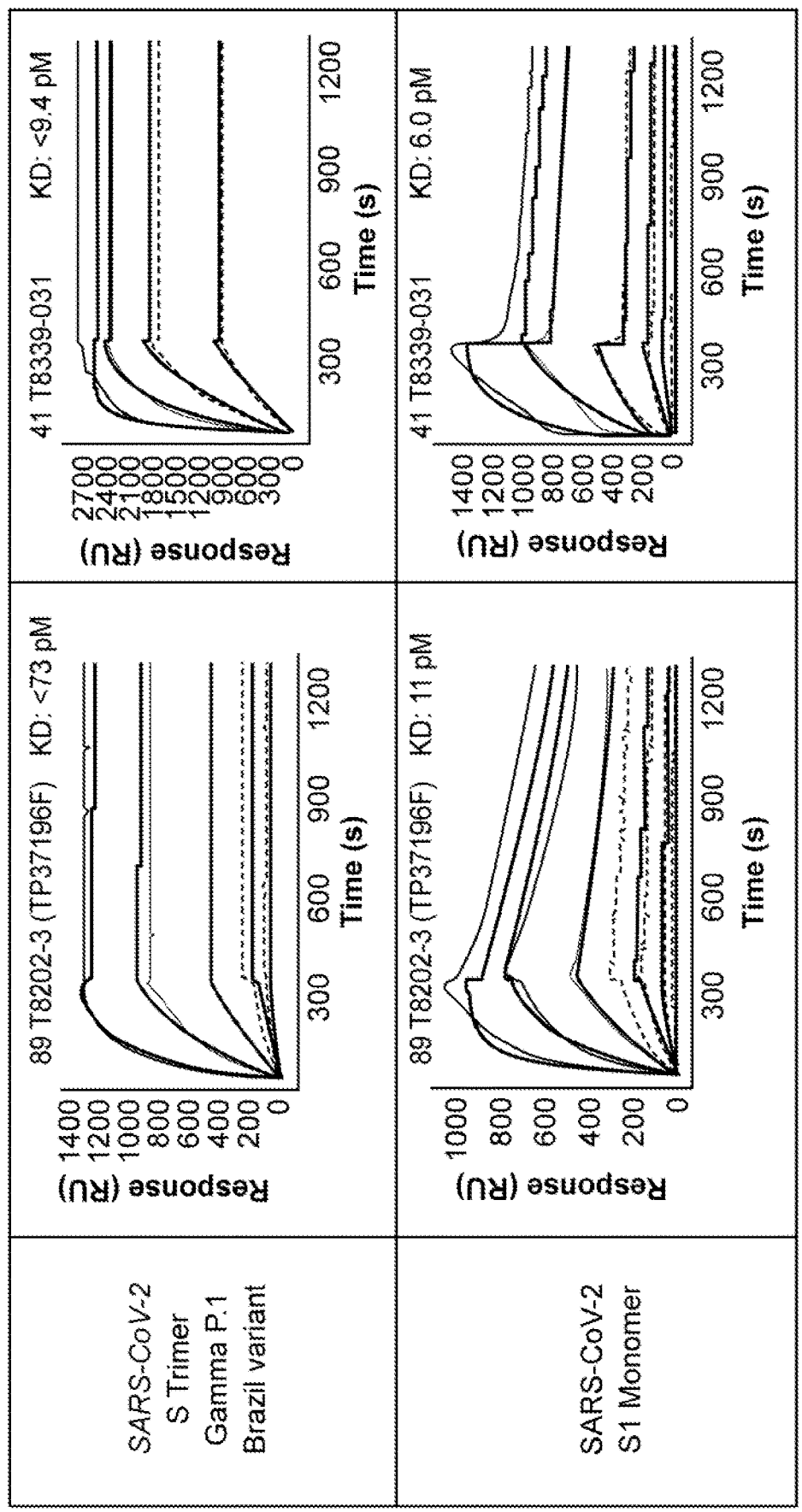

FIGS. 29A-29C depict SPR using 202-03 and 339-031. From the SPR data, the VHH leads were further assessed for binding ability against the SARS-CoV-2 variants of concern.

FIG. 30 depicts a summary of the kinetic data for individual VHH antibody variants 202-03 and 339-031. Equilibrium association (e.g., Ka) and dissociation (e.g., Kd) constants, as well as the affinity of the antibody to the respective receptors (e.g., KD), were calculated. Low calculated KD values are suggestive of a high apparent binding affinity and high calculated KD values are suggestive of low apparent binding affinity. Based on these data, the two VHH antibodies were selected for construction of the bispecific product.

FIG. 31 depicts epitope bin heat maps for WA1 S trimer and Delta S Trimer.

FIG. 32 describes SARS-CoV-2 spike mutations used in pseudovirus experiments.

Figure 33:
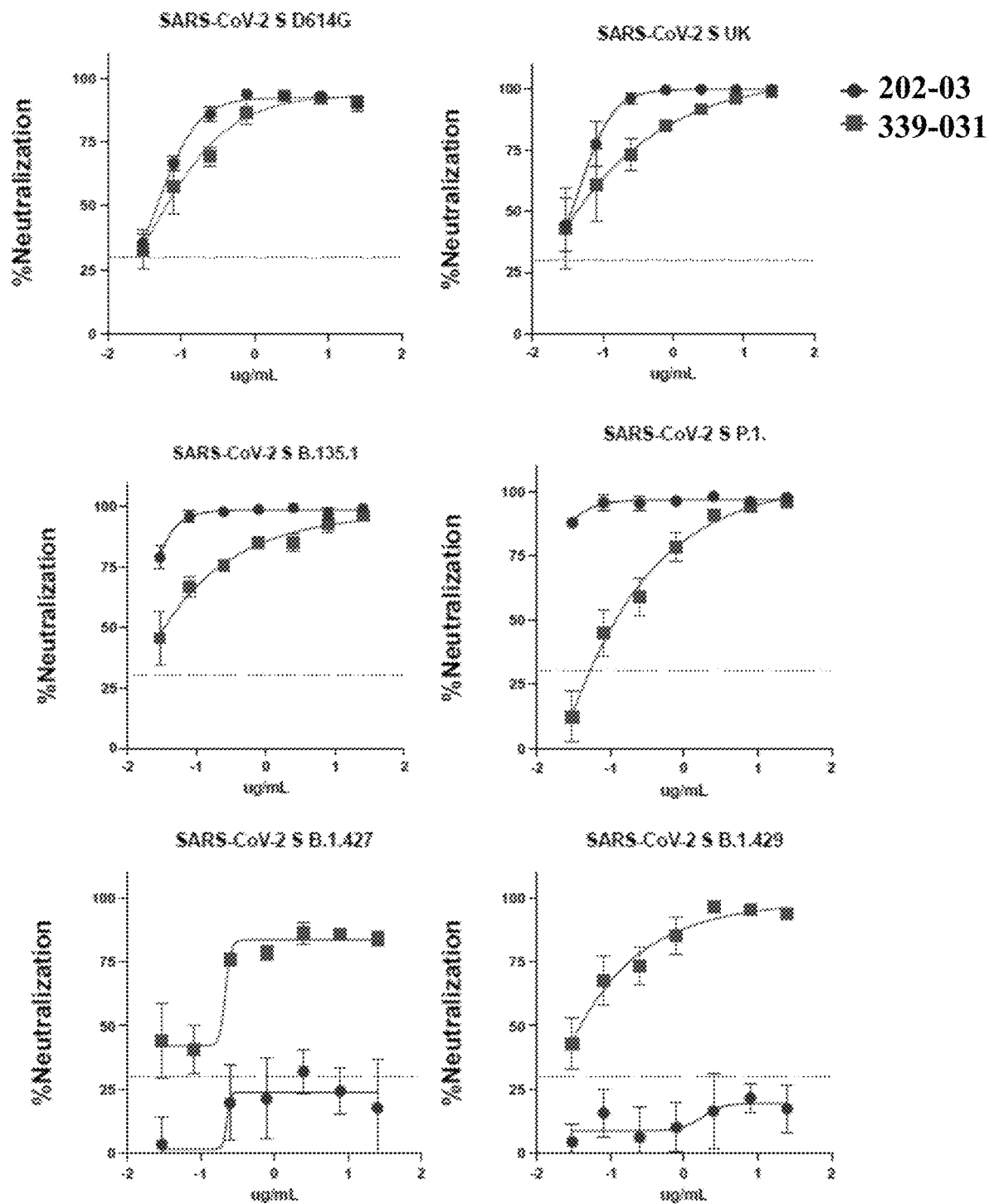

FIG. 33 shows plots of VHH antibody neutralization potential across SARS-CoV-2 variants of concern using representative pseudovirus.

Figure 34:
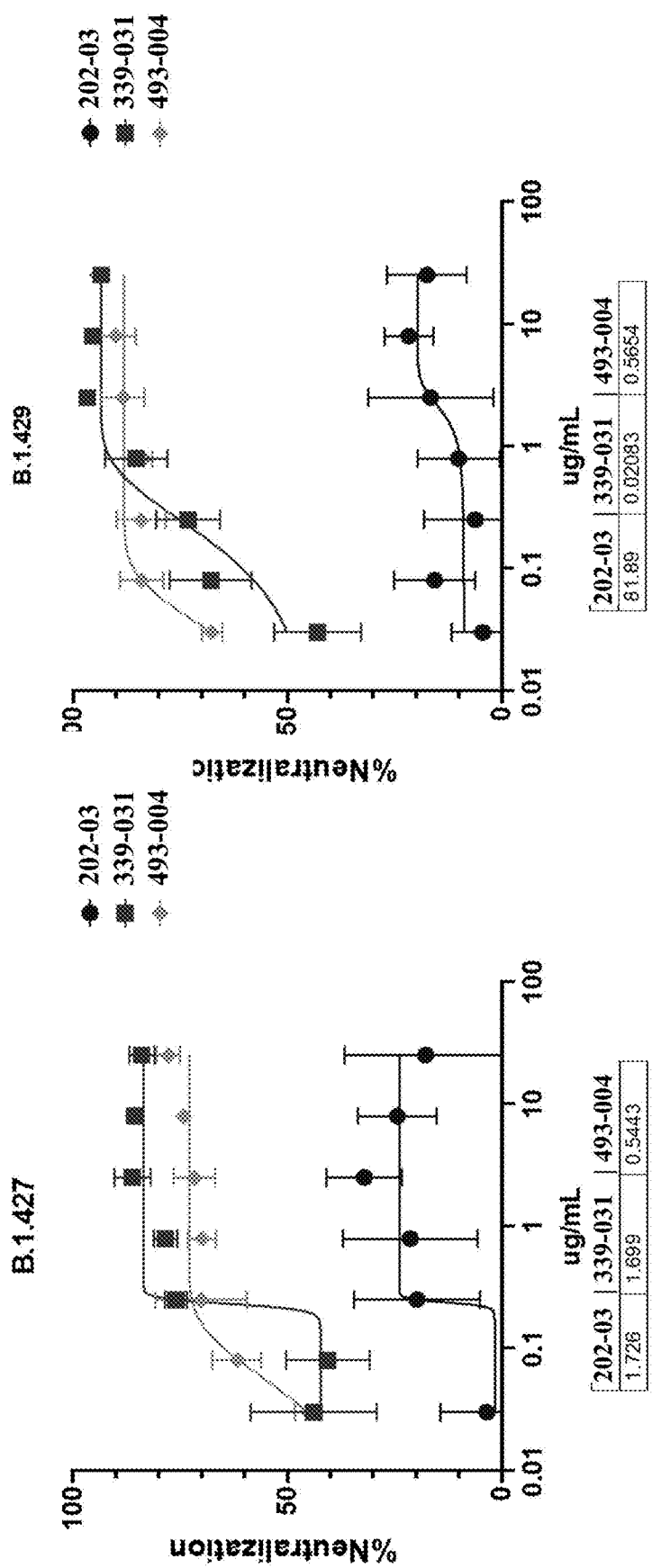

FIG. 34 shows neutralization activity of the antibodies 202-03 and 339-031 with the bispecific antibody 493-004 against the two Epsilon variants (L452R mutations).

Figure 35:
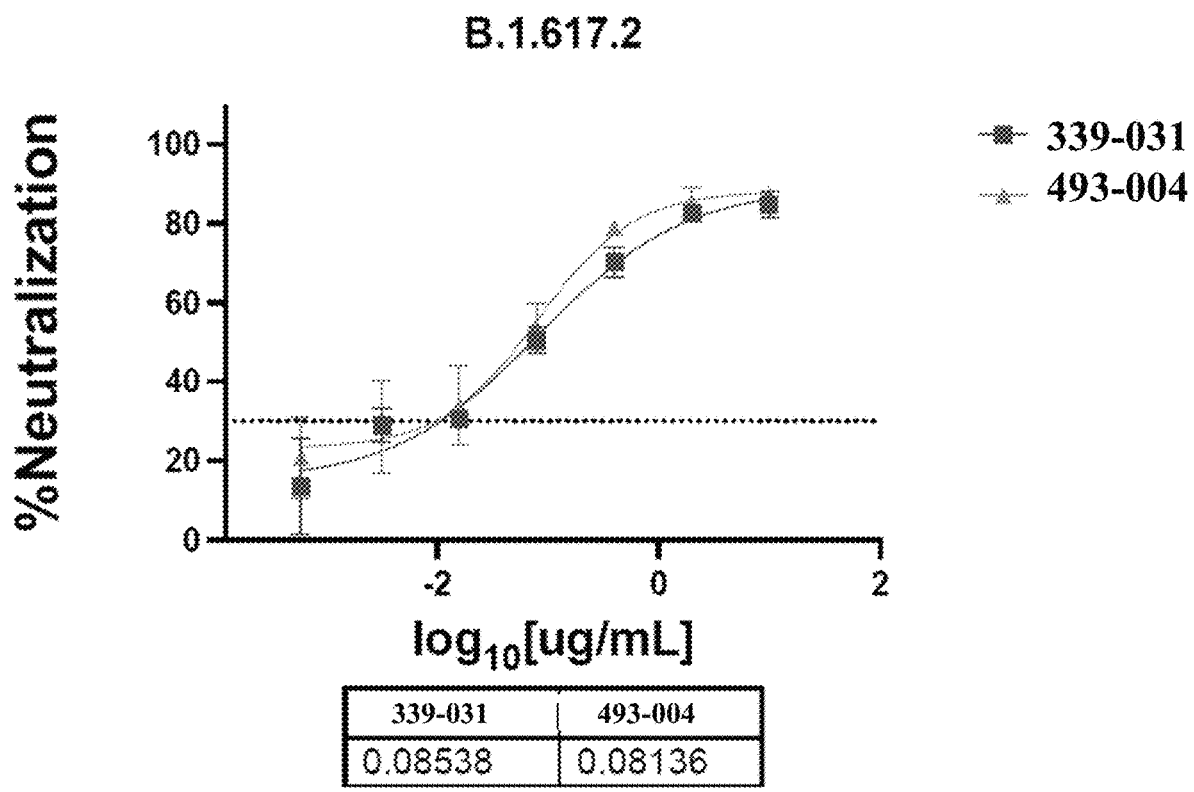

FIG. 35 shows pseudovirus for Delta (B.1.617.2) Neutralization Potential Using the VHH antibody 339-031 and the bispecific antibody 493-004.

Figure 36:
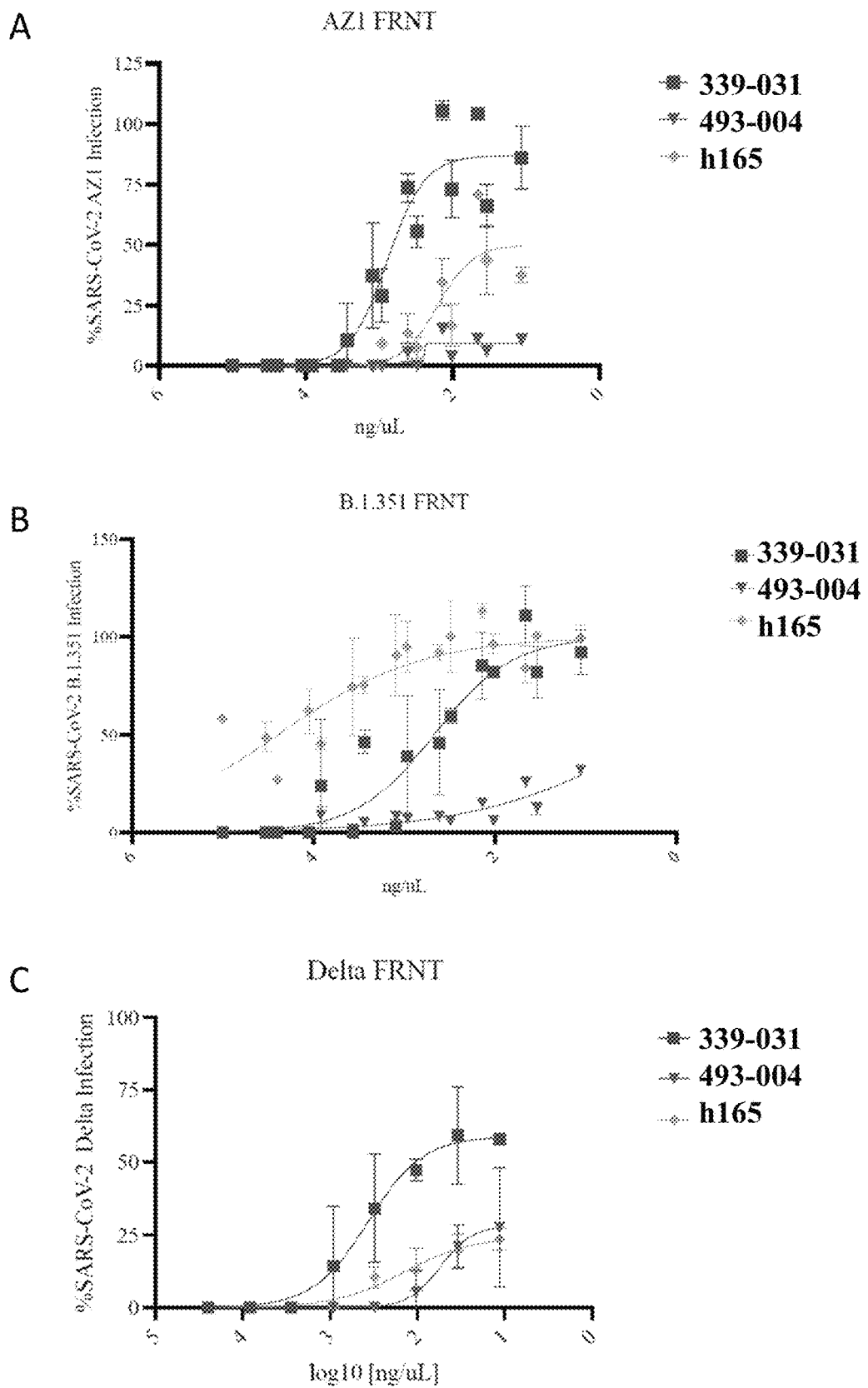

FIG. 36 shows live virus assays with the VHH antibody 339-031, the bispecific antibody 493-004, and a control h2165, using cells infected with SARS-CoV-2 (wild-type [AZ1] (Panel A), Beta [B.1.351] (Panel B), and Delta (Panel C)) variants.

Figure 37:
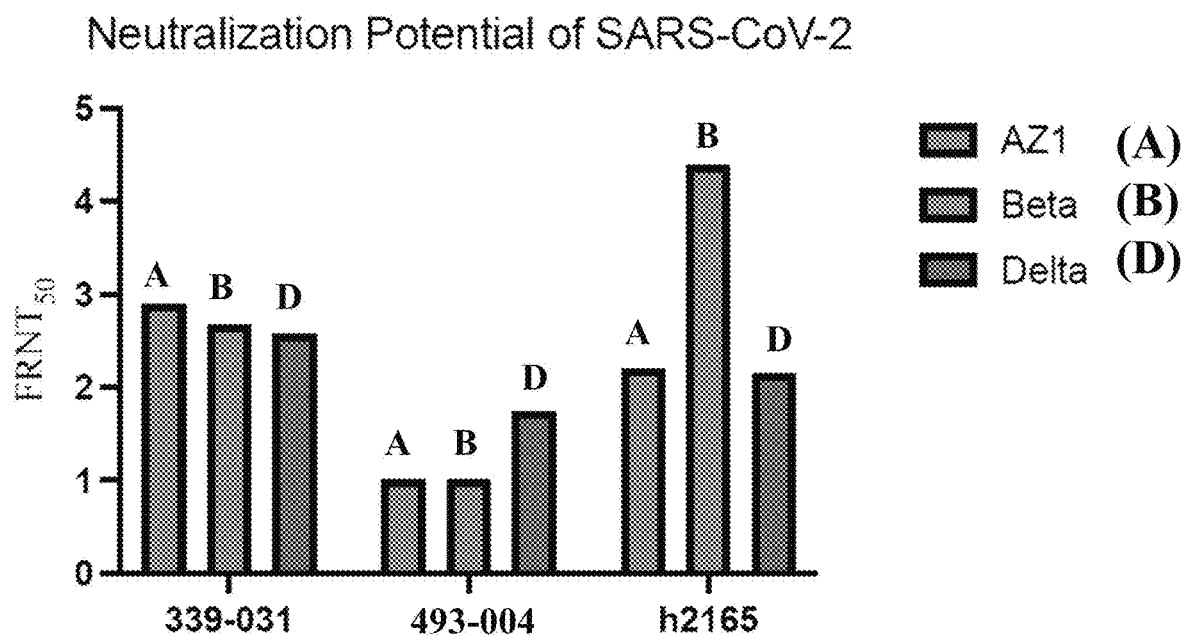

FIG. 37 shows neutralization potential of antibody constructs using $FRNT_{50}$ measures.

Figure 38:
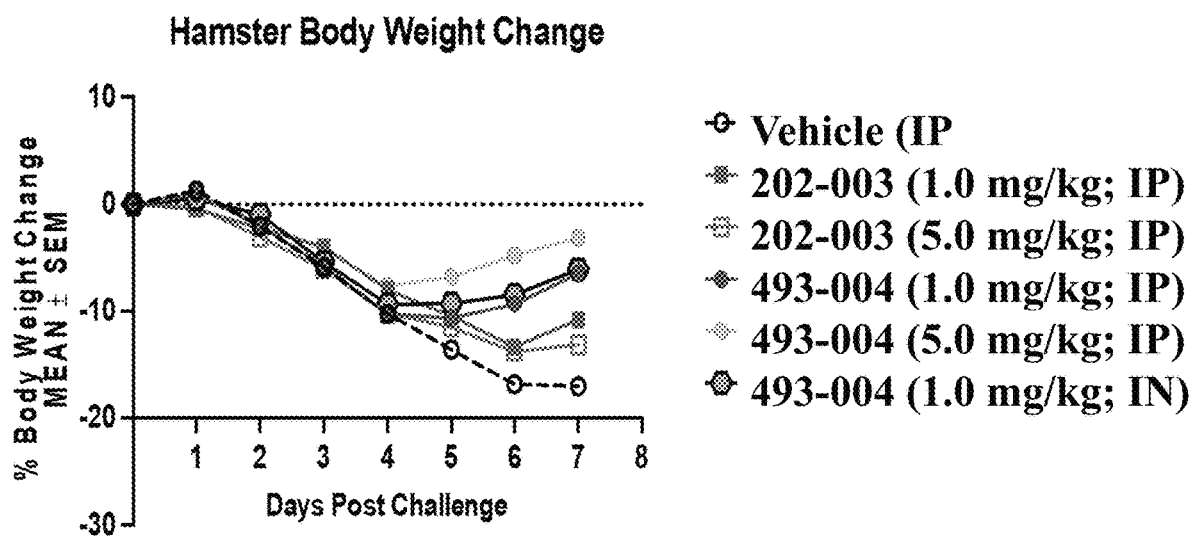

FIG. 38 shows that the bispecific antibody administered at either 1 mg/kg or 5 mg/kg by intraperitoneal injection and 1 mg/kg intranasally, resulted in improved body weights in the animals starting 4-days after start of the challenge.

Figure 39:
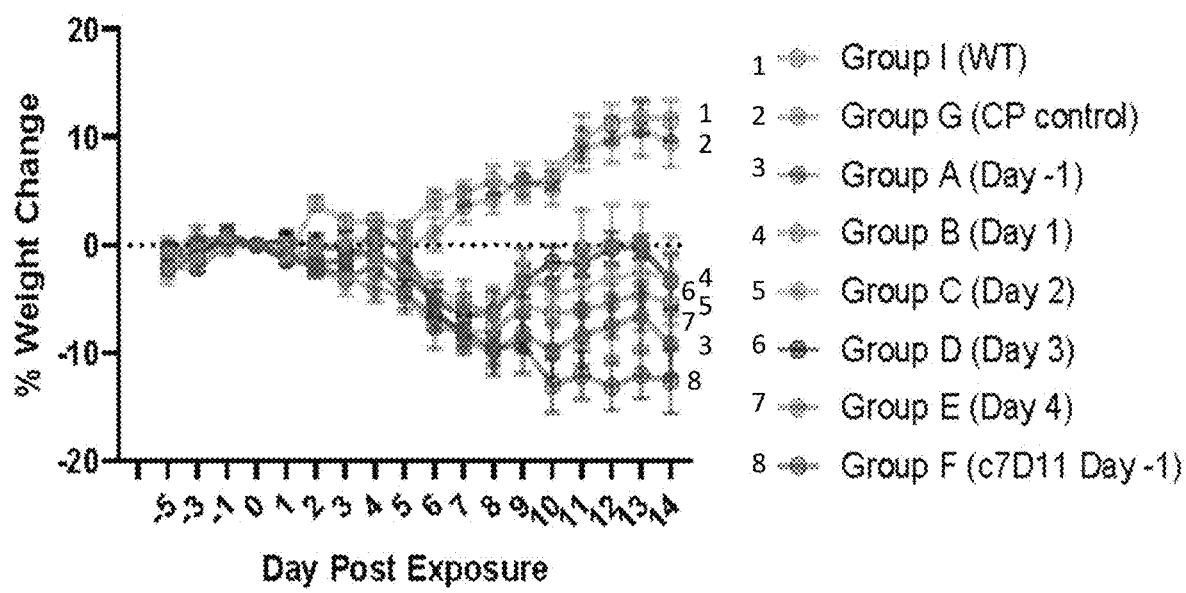

FIG. 39 shows that the bispecific antibody appears to demonstrate a therapeutic response and animal weights increased after administration of the antibody on each of the days administered (e.g., day 1, 2, 3, or 4 post-infection).

Figure 40A:
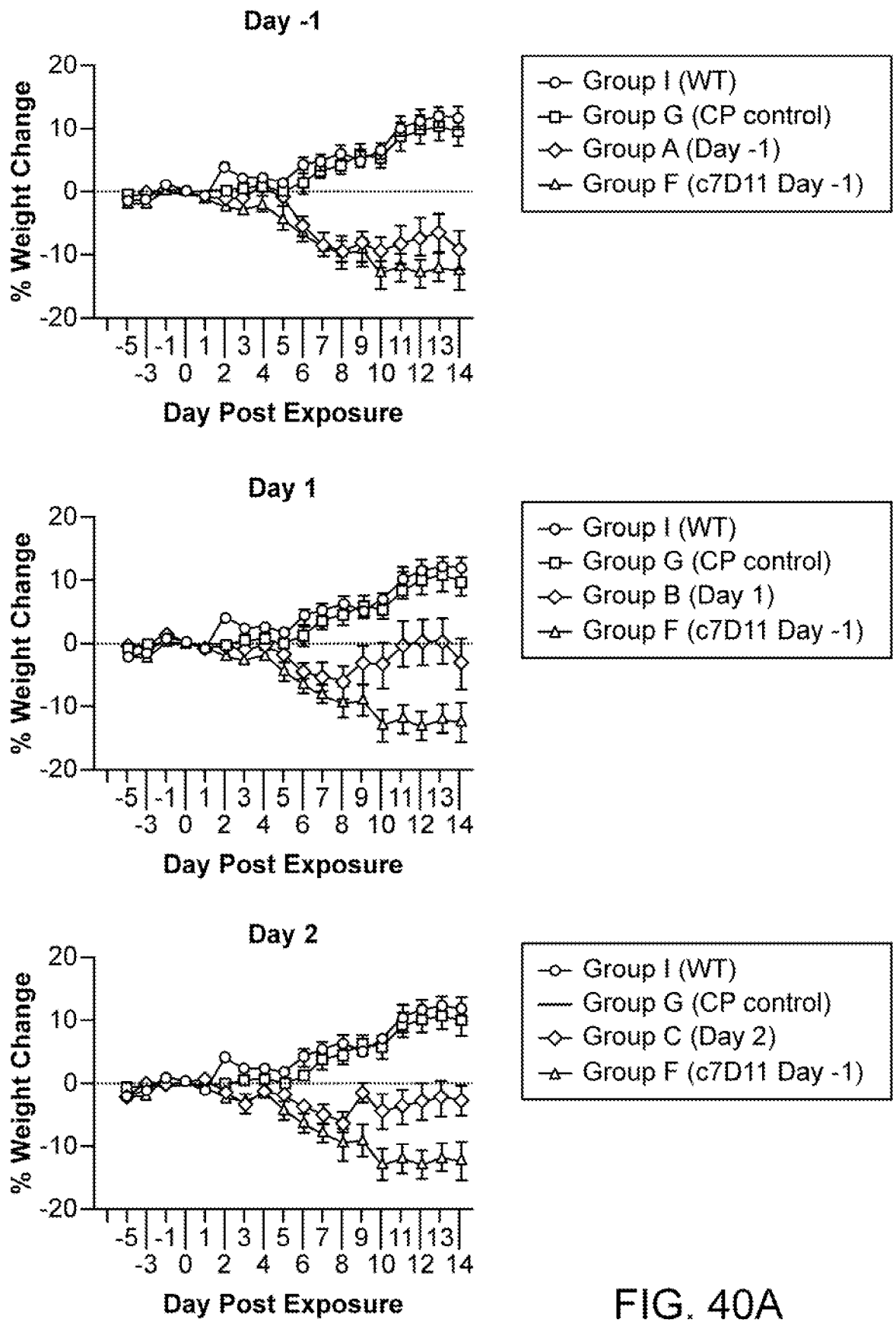
Figure 40B:
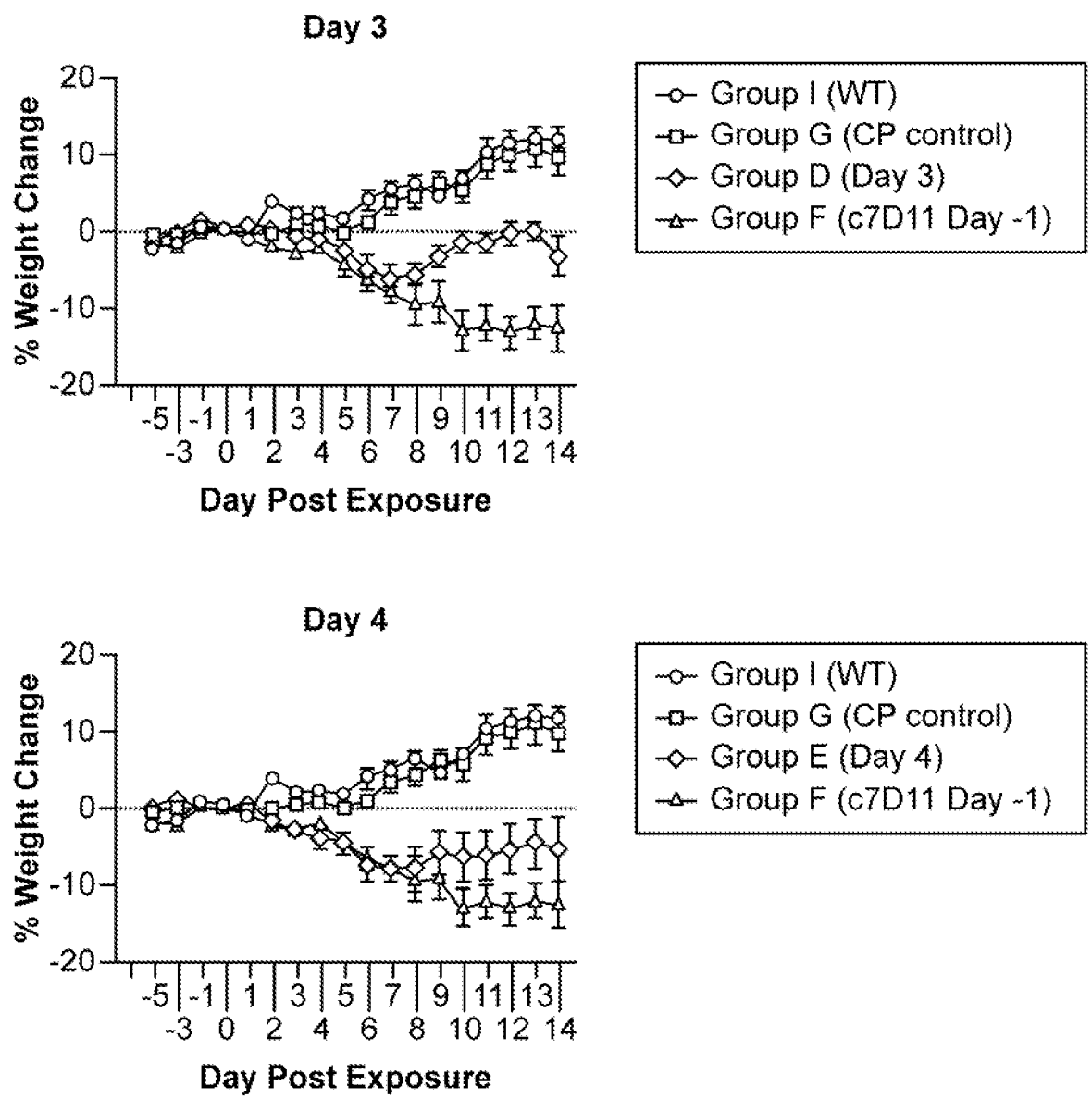

FIGS. 40A-40B show preliminary weight data from all treated animal groups, by day (−1, +1, +2, +3, and +4) post-infection.

Figure 41A:
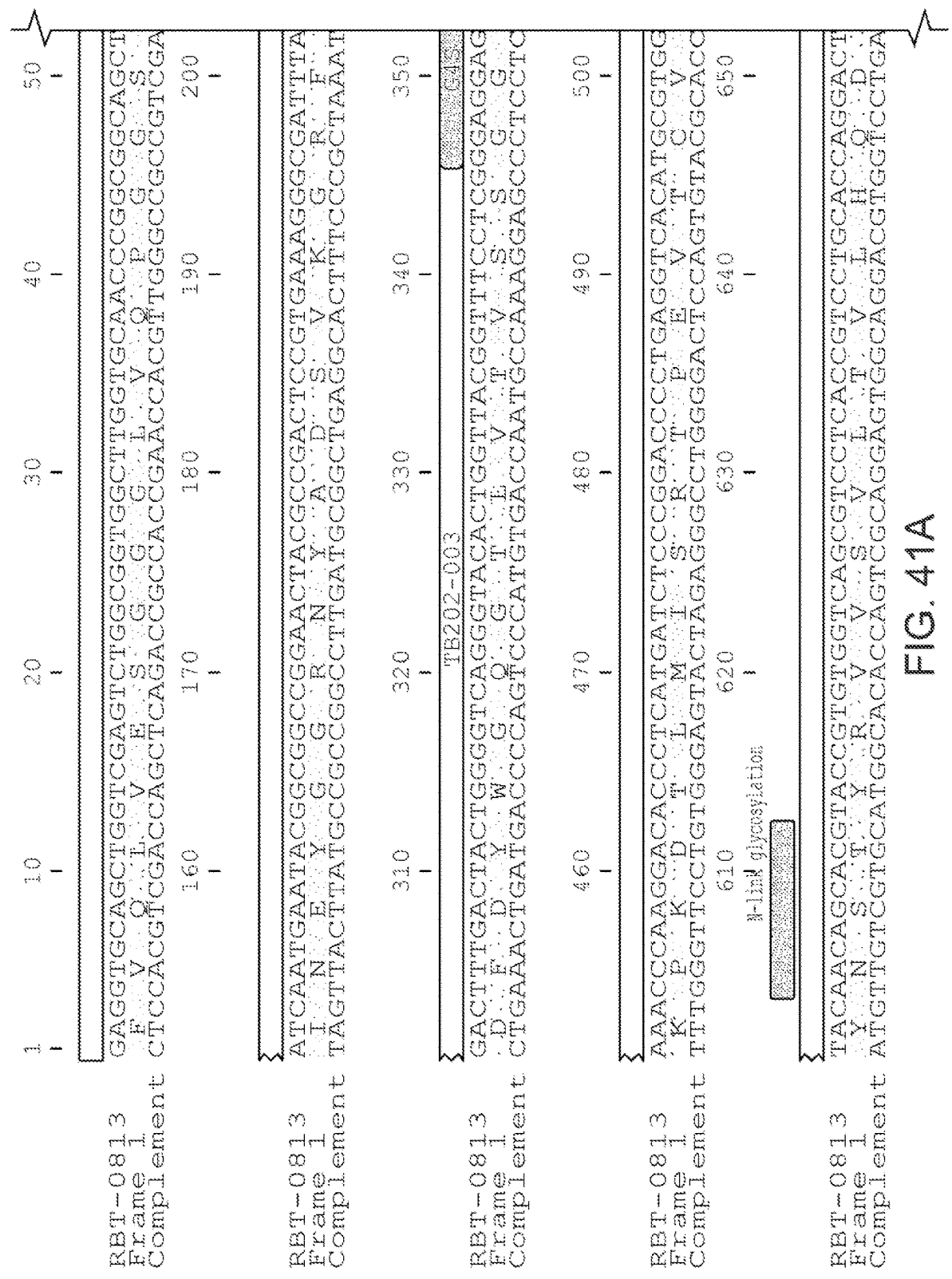
Figure 41B:
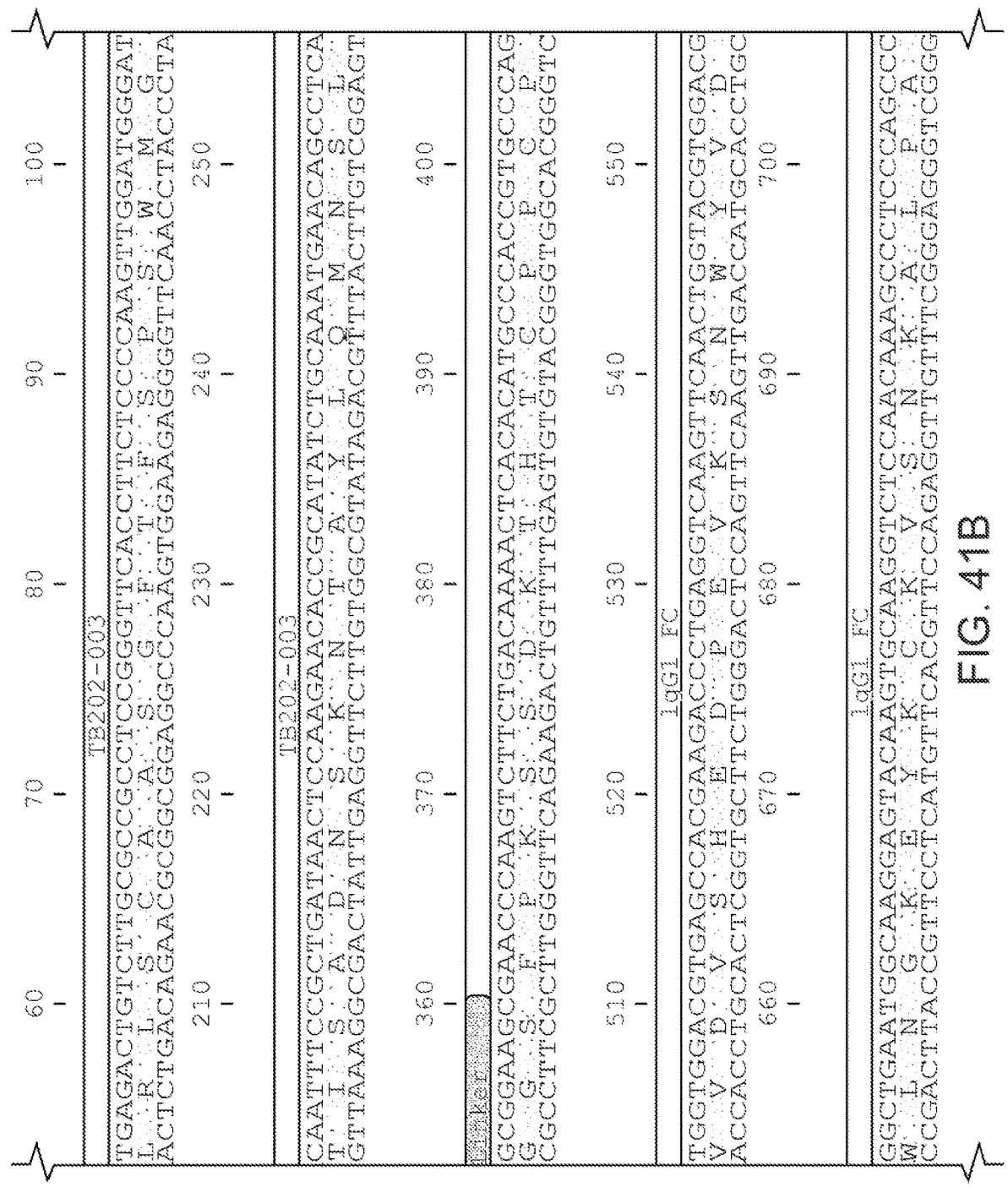
Figure 41D:
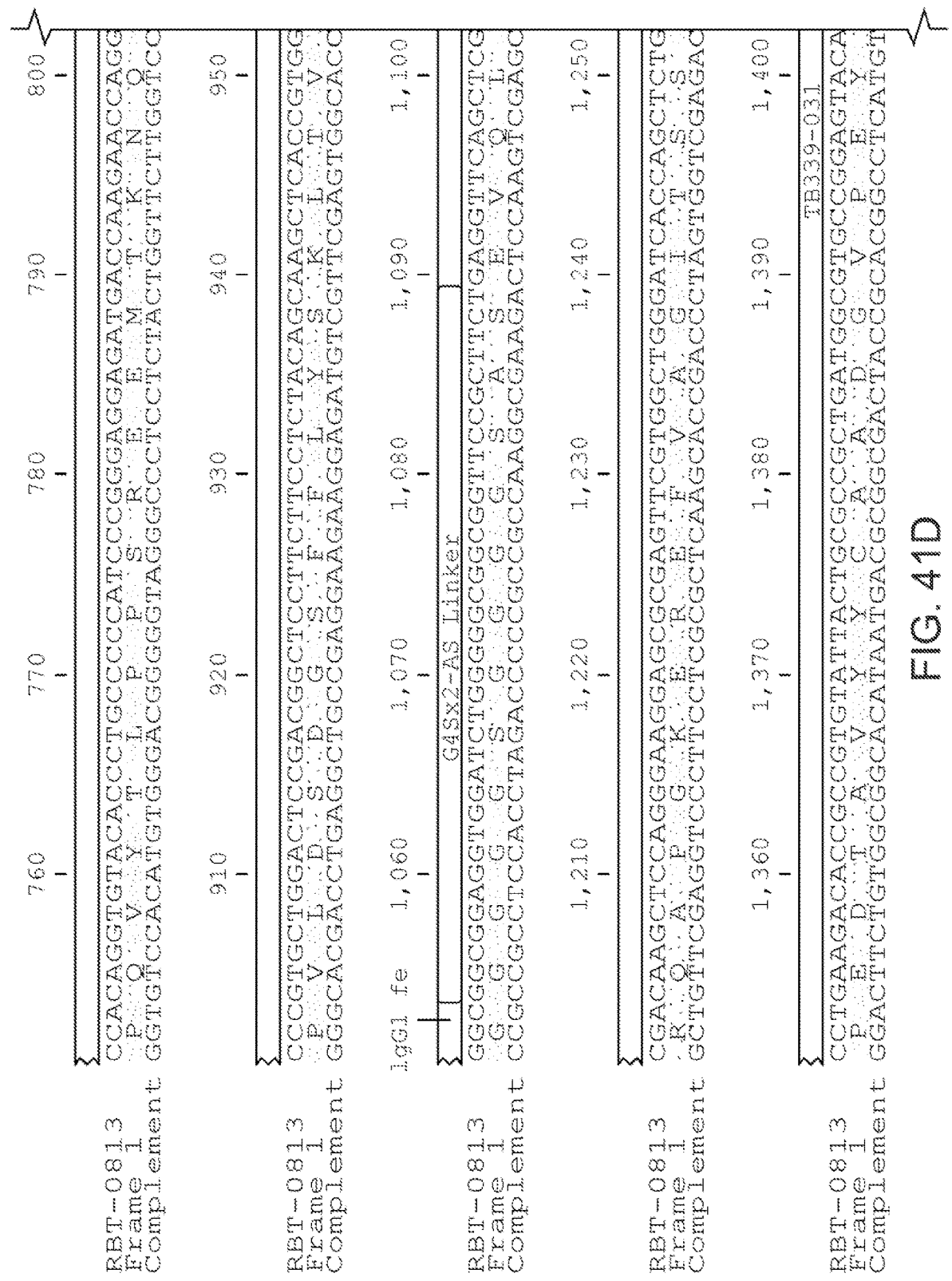
Figure 41E:
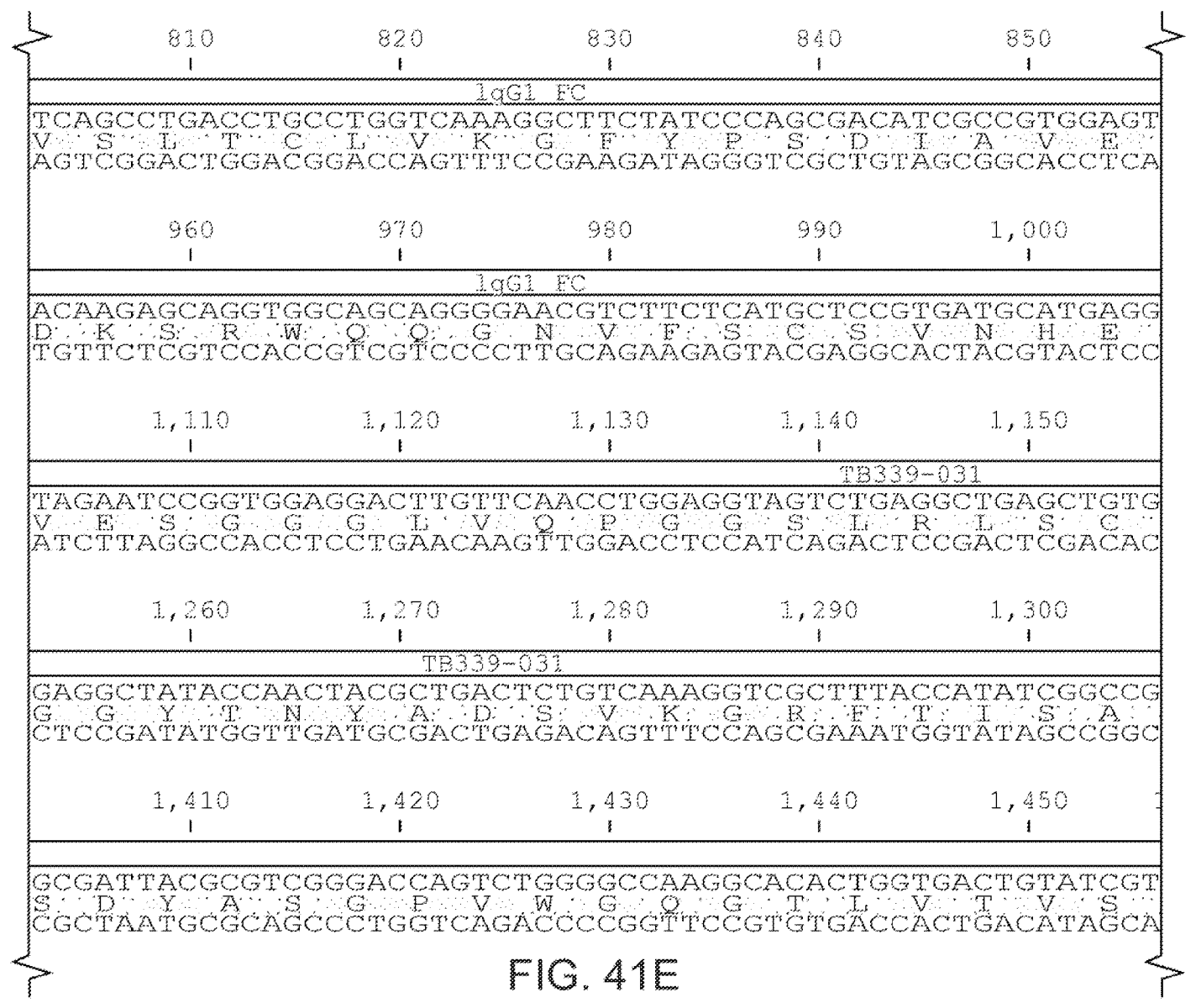
Figure 41F:
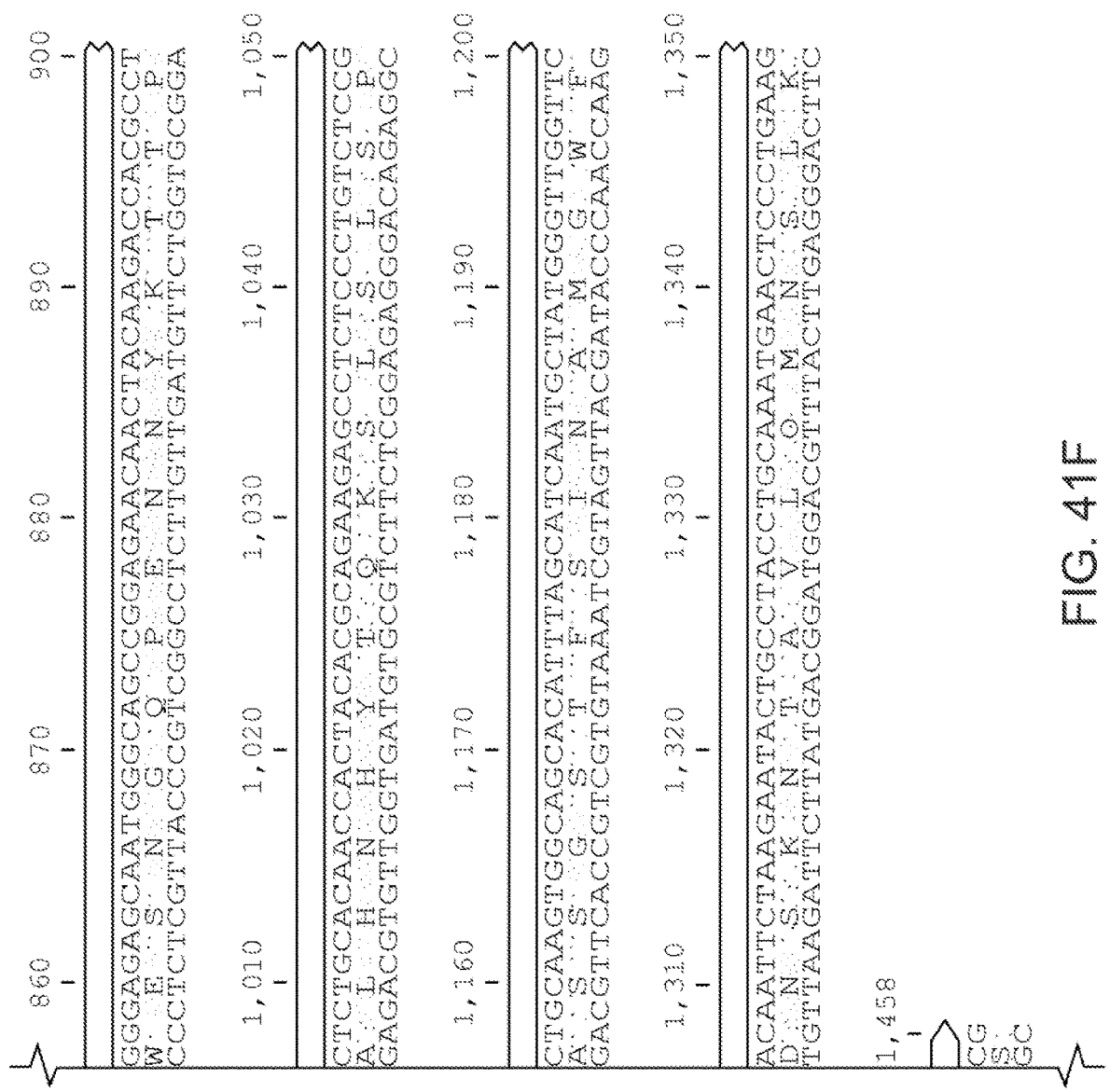

FIGS. 41A-41F show a complete double stranded DNA and amino acid sequence of bispecific monoclonal antibody 493-004 showing the location of VHH antibodies, G4S linkers (SEQ ID NO: 2671), IgG1 Fc, and N-link glycosylation. Figure discloses SEQ ID NOs: 2677 and 2678, respectively, in order of appearance. FIG. 41A depicts the top left portion of the sequence. FIG. 41B depicts the top middle portion of the sequence. FIG. 41C depicts the top right portion of the sequence. FIG. 41D depicts the bottom left portion of the sequence. FIG. 41E depicts the bottom middle portion of the sequence. FIG. 41F depicts the bottom right portion of the sequence.

Figure 42:
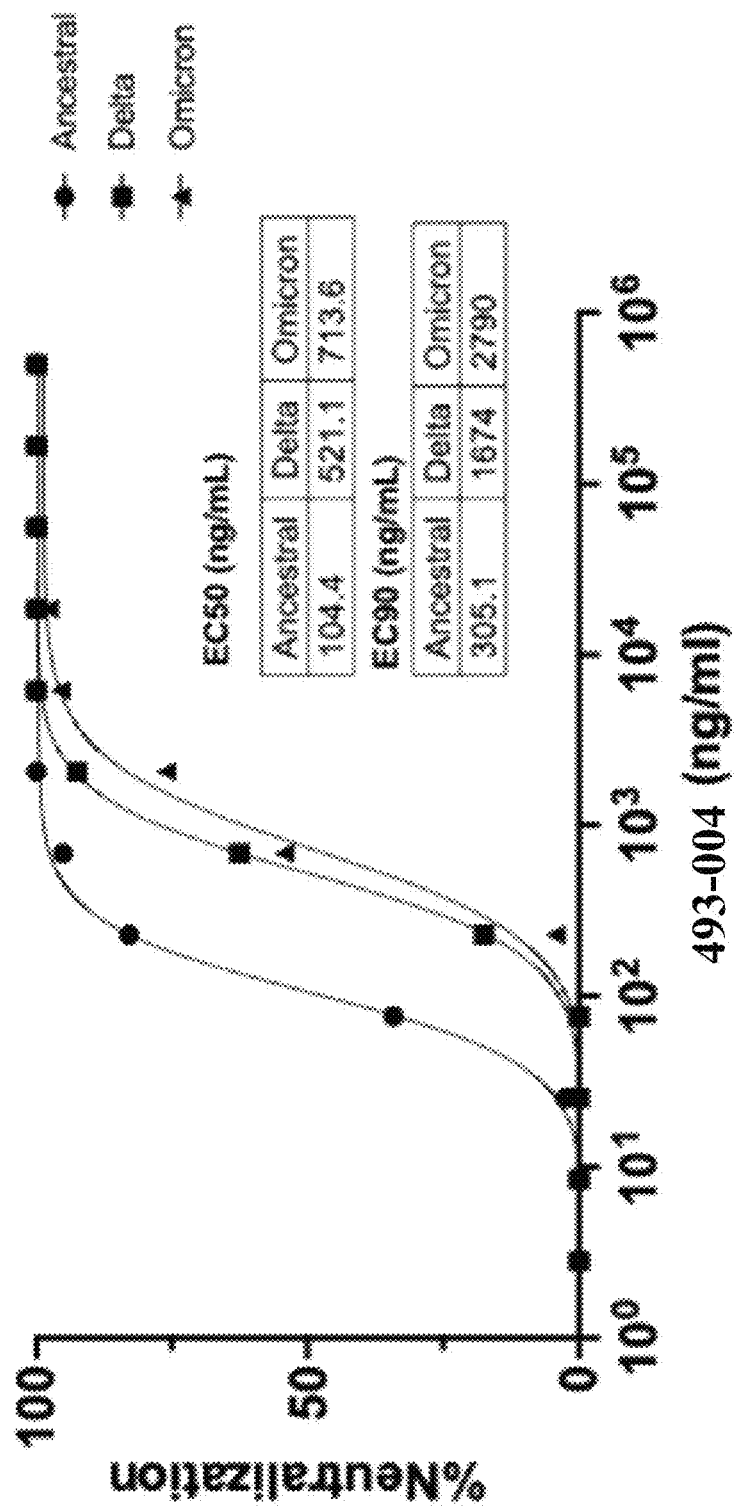

FIG. 42 shows the neutralization assessment of antibody 493-004 in a live virus plaque reduction assay using dose response curves, $EC_{50}$, and $EC_{90}$ determinations for antibody 493-004 against ancestral, delta, and omicron variants of the SARS-CoV-2 virus.

Figure 43A:
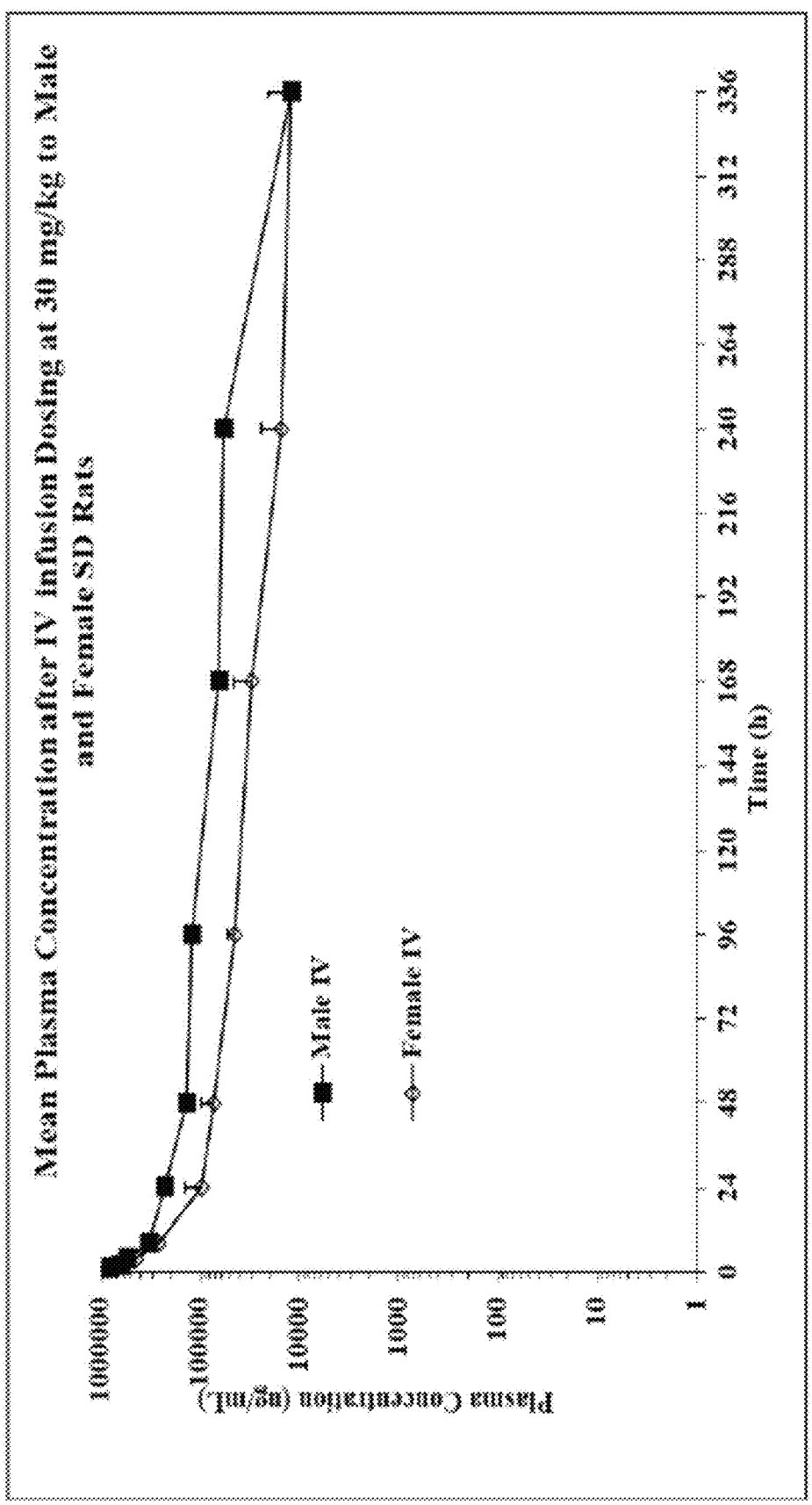
Figure 43B:
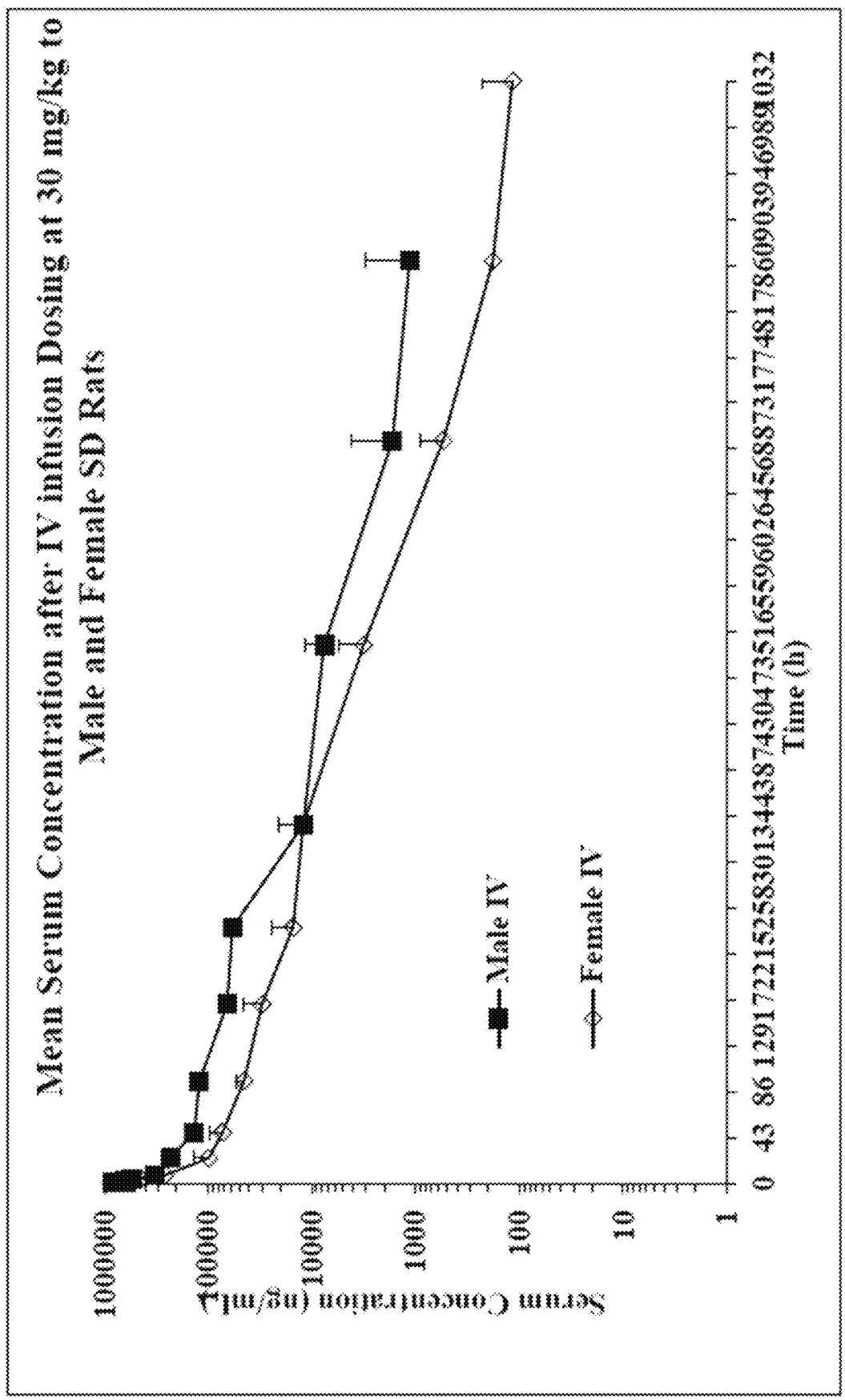

FIGS. 43A-43B depict the mean two-week plasma expires in a rat following a single intravenous infusion of 30 mg/kg (FIG. 43A) and following IV infusion dosing at 30 mg/kg across the entire 42-week study FIG. 43B).

Figure 44:
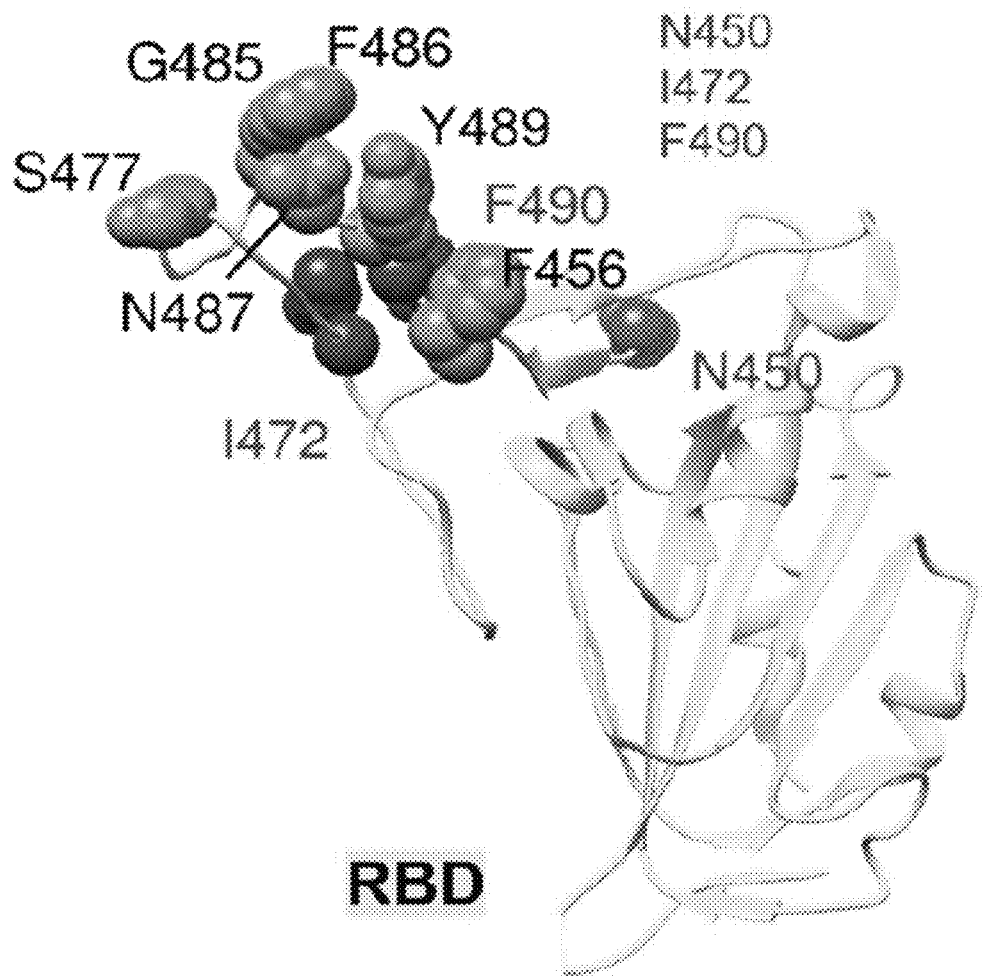

FIG. 44 depicts results of alanine mutational analysis of the individual VHH antibodies 339-031 and 202-03 and identified critical contact points.

Figure 45:
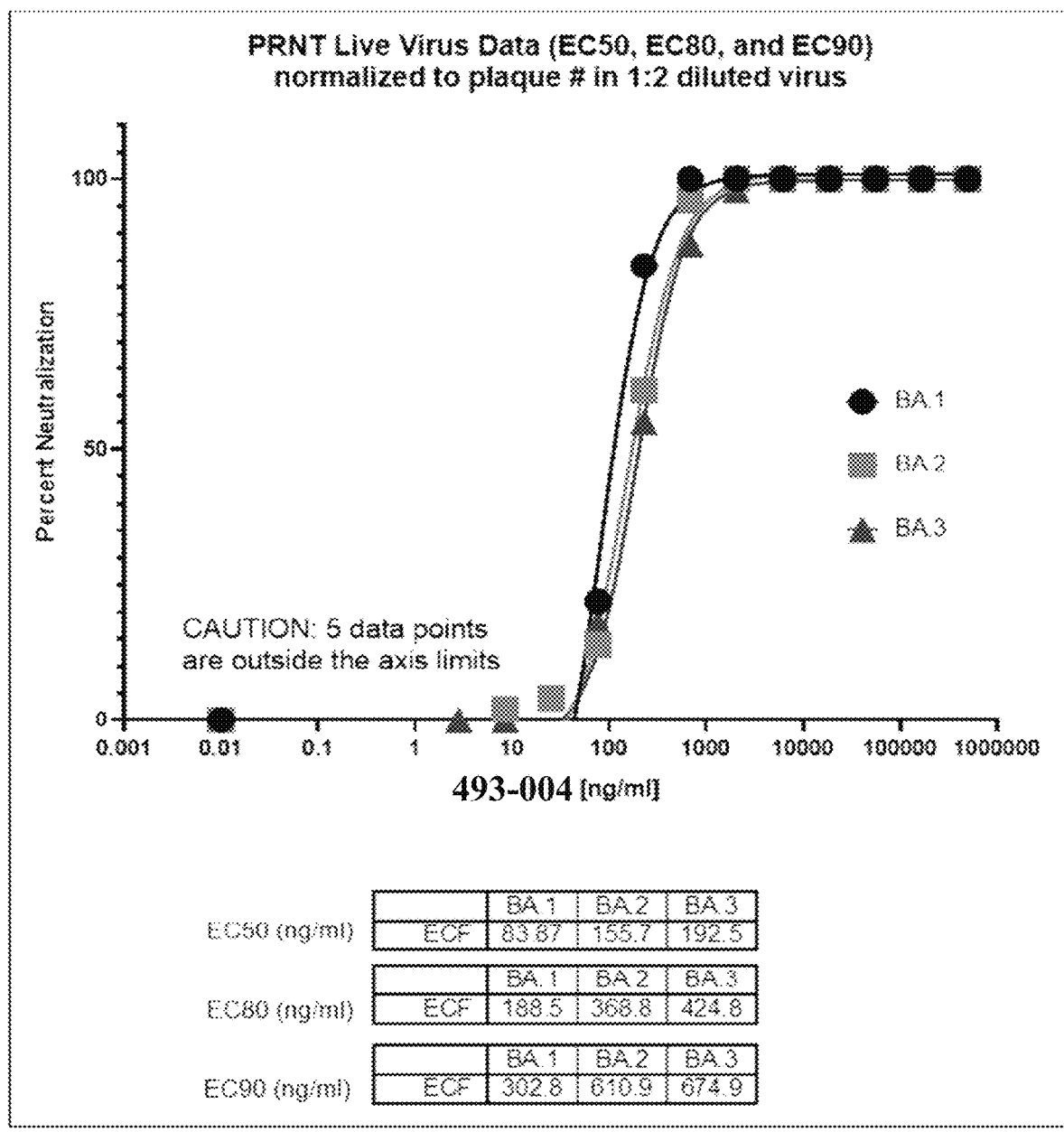

FIG. 45 shows graphical display, $EC_{50}$, and $EC_{90}$ results of virus neutralization of omicron lineages BA.1, BA.2, and BA.3 with bispecific antibody 493-004.

FIGS. 46A-46C show the results of the top ten clones (FIG. 46A), the top two clones (FIG. 46B), and the top clone (FIG. 46C) used in development of the antibody 493-004 stable cell line.

FIG. 47 shows the drug substance specifications for the pharmaceutical formulation of monoclonal antibody 493-004.

FIG. 48A shows the experimental design for a pharmacokinetic study in rats.

FIG. 48B shows a sample collection schedule.

Figure 49:
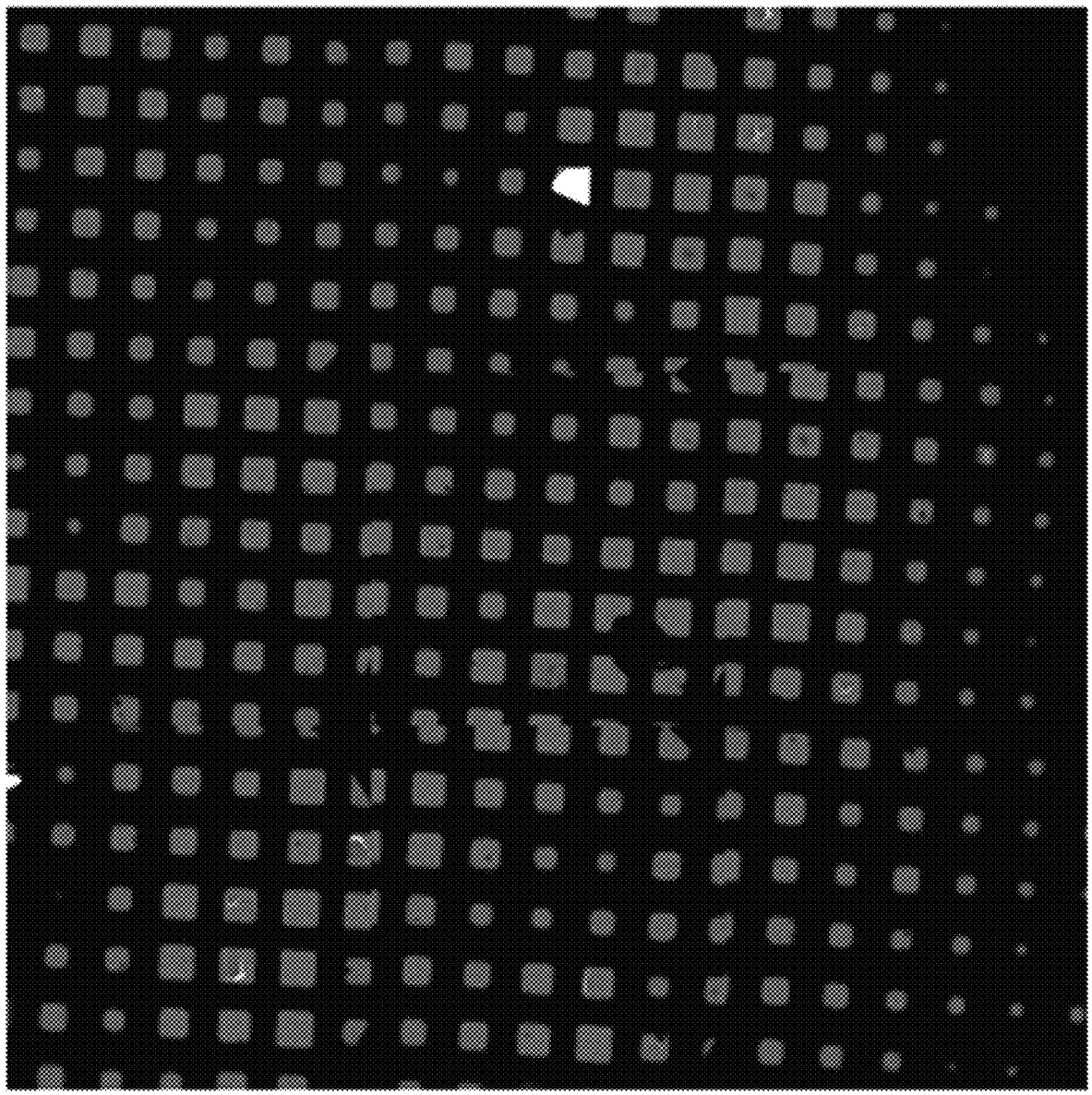

FIG. 49 shows an overview atlas of a measurement grid for CryoEM analysis.

Figure 50:
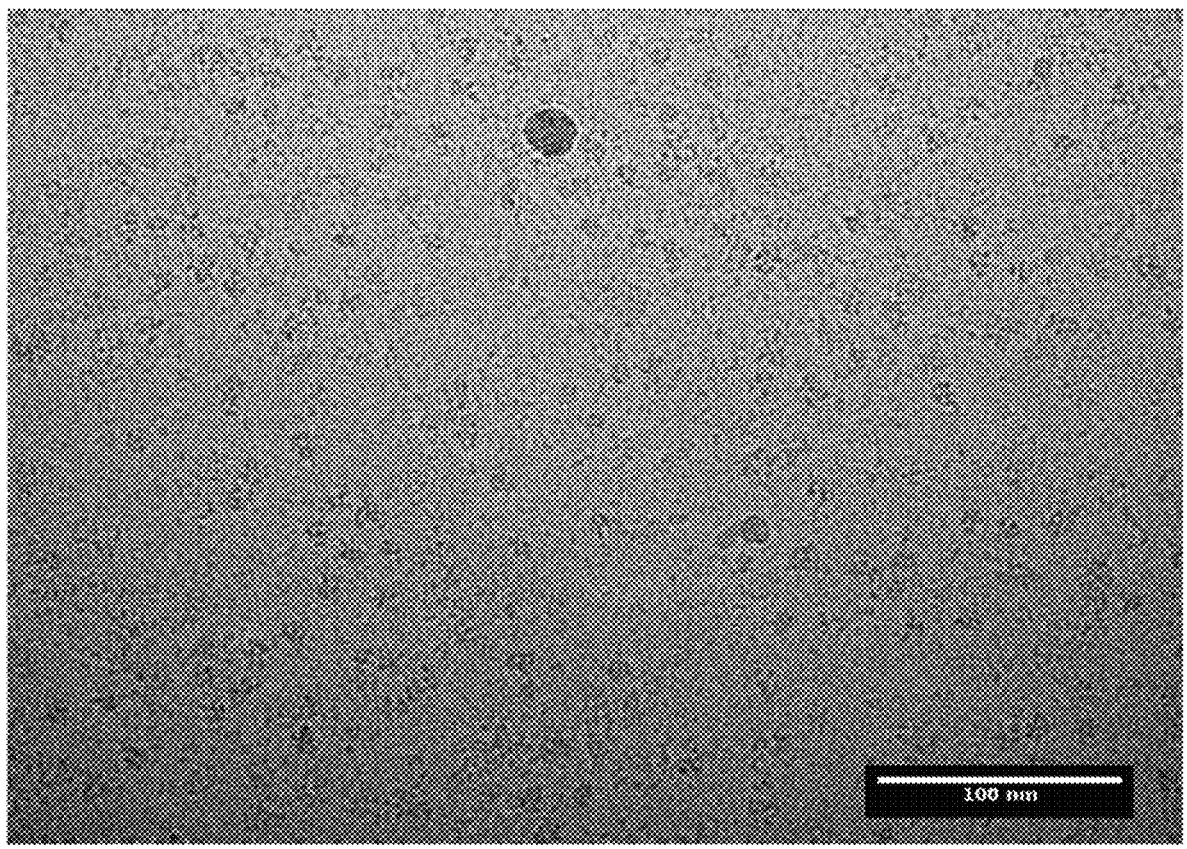

FIG. 50 shows an example motion corrected micrograph from data collection during CryoEM experiments.

Figure 51A:
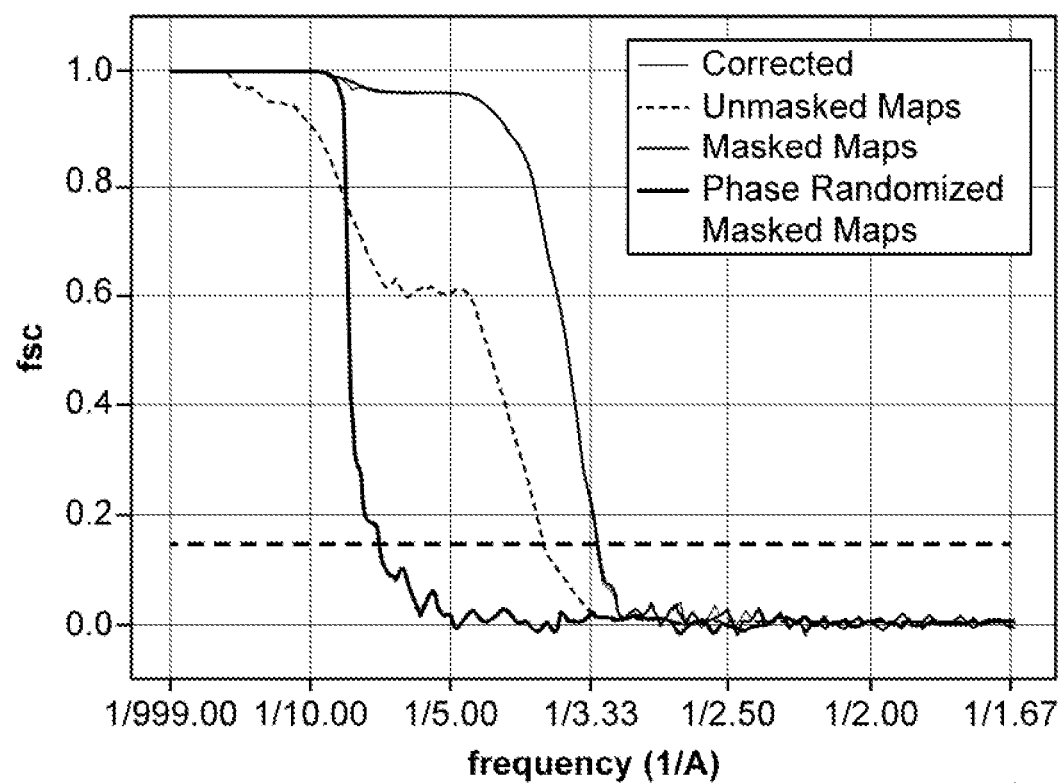
Figure 51B:
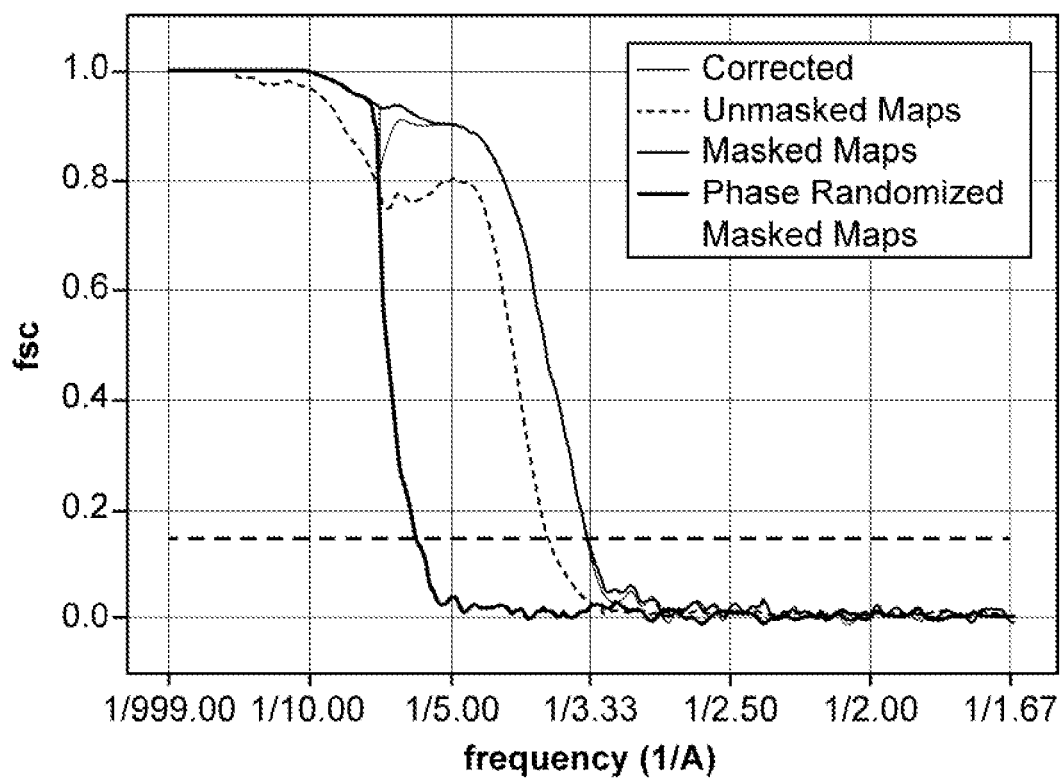
Figure 51C:
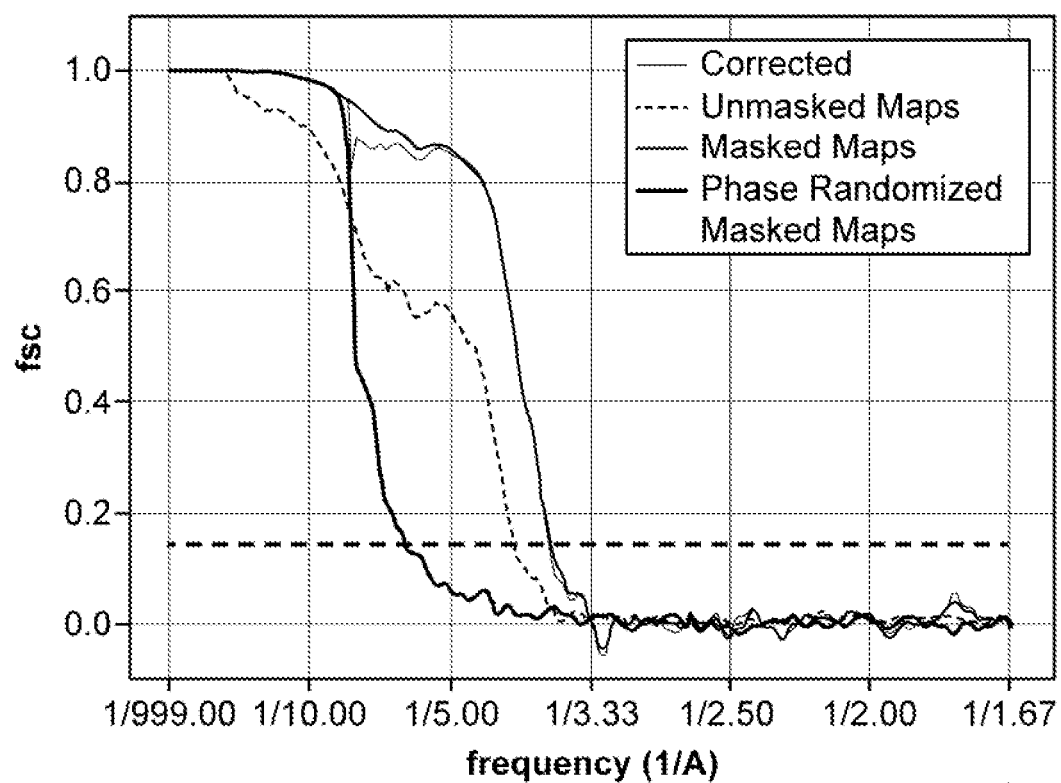
Figure 51D:
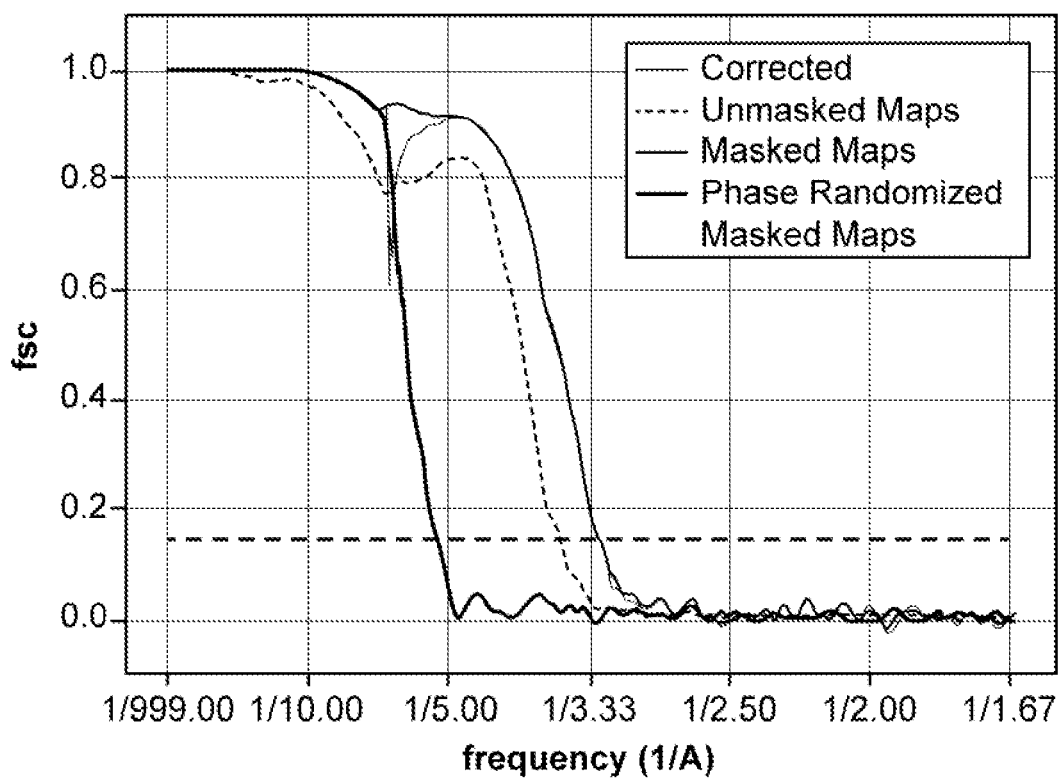

FIGS. 51A-51D depict the 3D classification models from the results of the CryoEM experiments. Shown here are the 3.2 Å resolution "initial consensus map" (FIG. 51A); the 3.4 Å resolution M4.3 map, used to build the majority of the VHH1 epitope/paratope (FIG. 51B); the 3.7 Å resolution M4.4 map, used to build the N-terminal chain epitope of VHH in position 1 (FIG. 51C); and the 3.3 Å resolution M4.5 map, used to build the VHH2 epitope/paratope (FIG. 51D).

Figure 52A:
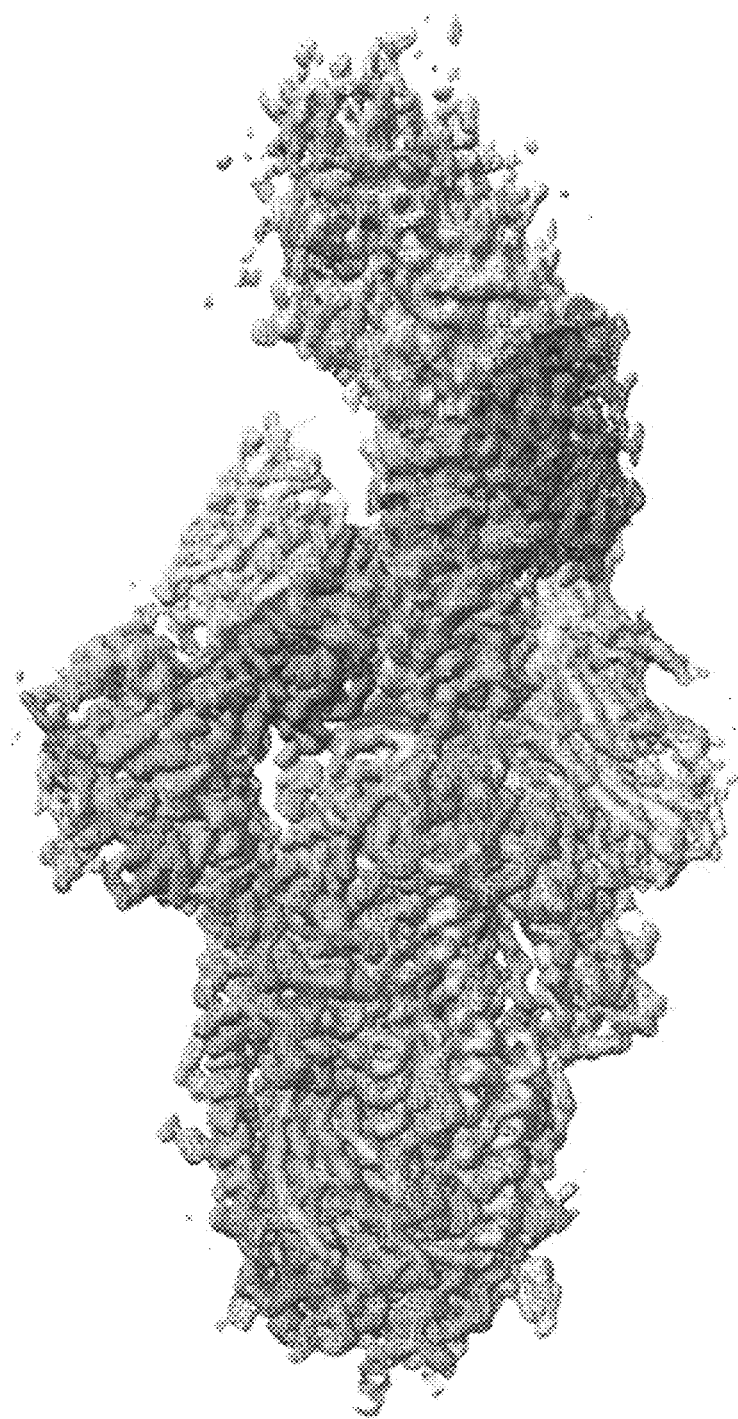
Figure 52B:
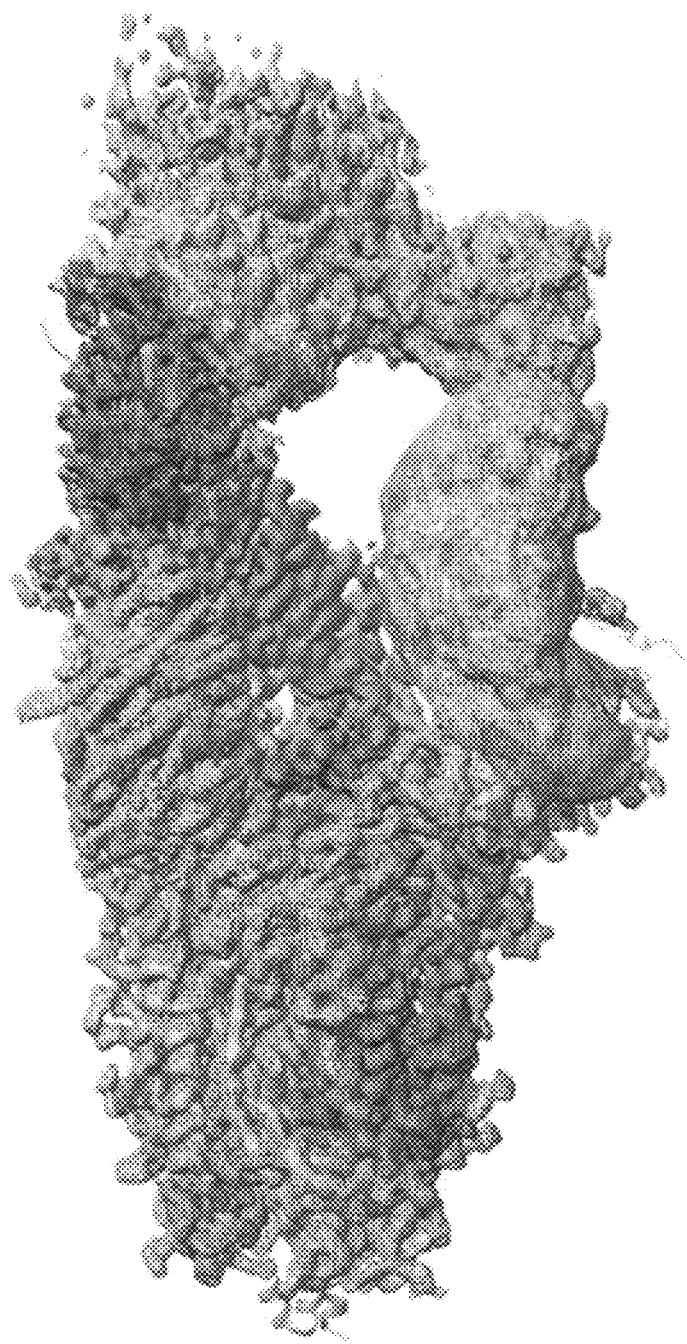
Figure 52C:
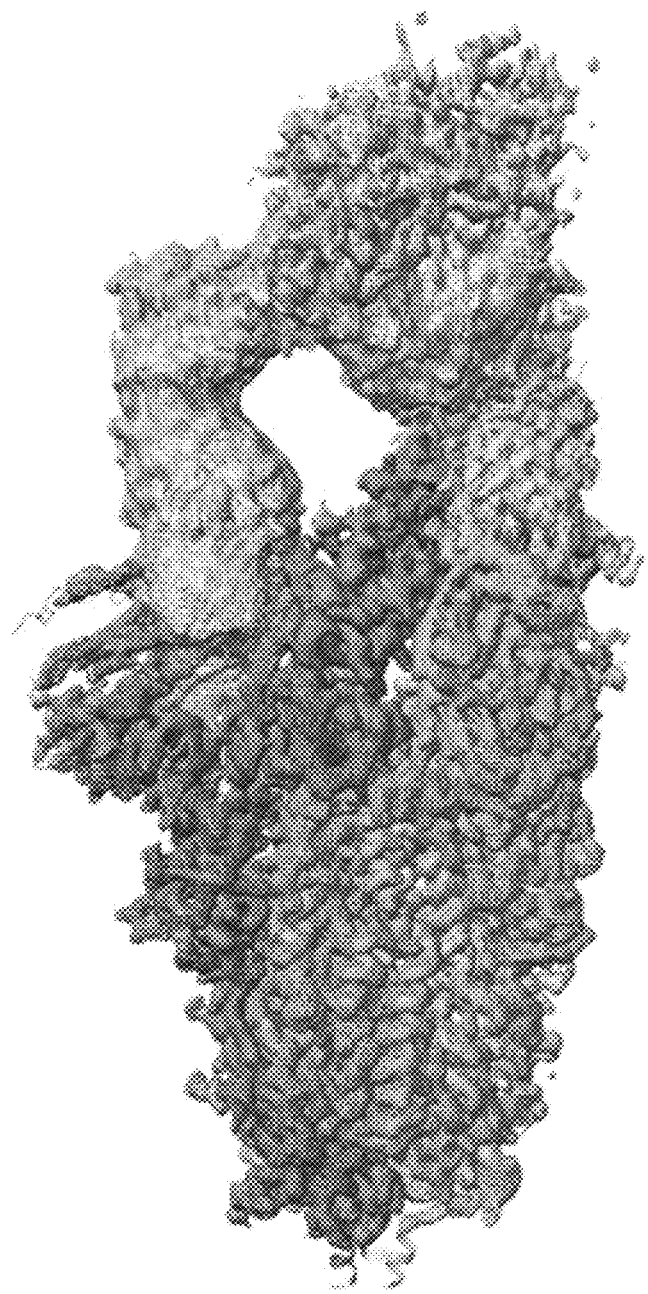
Figure 52D:
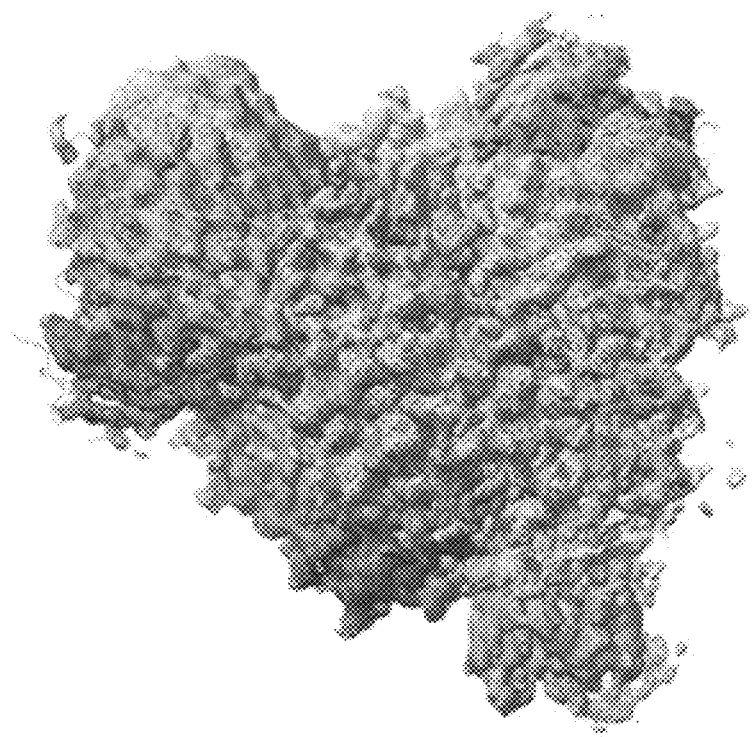

FIGS. 52A-52D show a mashup of the reconstructed maps such that each part of the spike trimer-bispecific antibody structure is represented in the best resolution obtained. Magenta/Red/Green represent monomers of the spike trimer, further denoted as chain A, chain B, and chain C, respectively. Grey density represents the bispecific antibody constant fragment. VHH1 is depicted in gold, VHH2 is blue, and VHH3 is orange. FIG. 52A shows an overview of the bispecific antibody layout at a side view. VHH1 is bound to the RBD down domain and VHH2 is bound to the neighboring RBD up domain. The constant fragment is located above the spike trimer, close to the spike center. FIG. 52B shows the front view (rotated 90 degrees vertically from FIG. 52A). VHH2 is bound to one of the RBD up domains while VHH3 is bound flexibly to the second RBD up domain. Both VHH2 and VHH3 share a strong constant fragment density. FIG. 52C shows the back view (rotated 180 degrees vertically from FIG. 52B). VHH3 is bound flexibly to the second RBD up domain while VHH1 is bound to the RBD down domain. FIG. 52D shows the top view of the spike trimer-bispecific antibody structure. VHH1 is located at the bottom and VHH2 is located in the upper right corner. Both VHH1 and VHH2 are partially covered by the constant fragment, while VHH3 is located on the left.

Figure 53A:
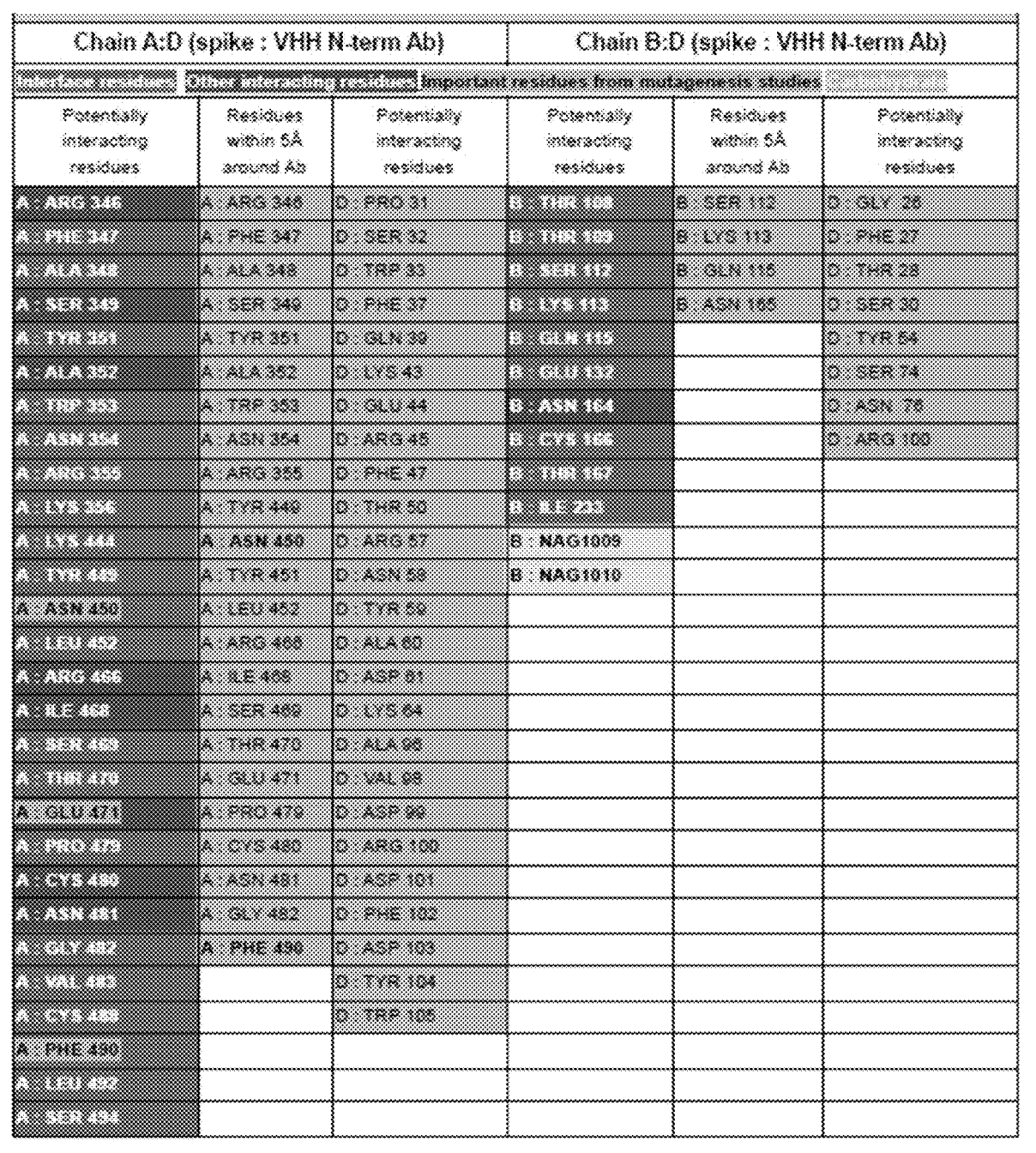

FIG. 53A shows an epitope/paratope overview of epitope 1.

FIG. 53B shows a list of explicit bonds.

FIG. 53C shows a comparison to mutagenesis studies where residues 450 and 490 were found to directly interact with the VHH. Residue 472 does not directly interact with the VHH but possibly serves as a stabilizer of interacting RBD loops, thereby contributing to the VHH/RBD interaction indirectly.

FIG. 54 shows a breakdown of the sequence of epitope 1. Figure discloses SEQ ID NO: 2679.

Figure 55A:
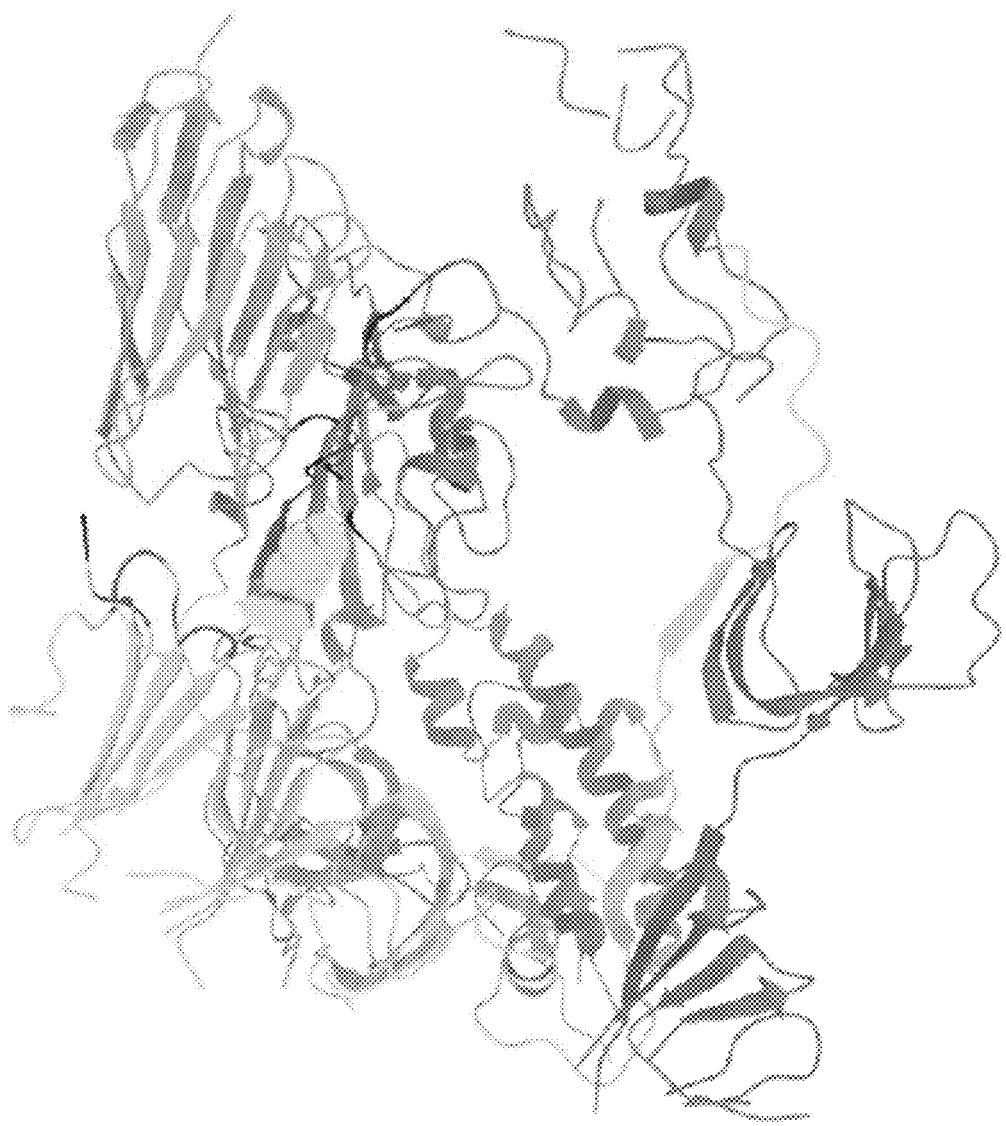

FIG. 55A shows a cartoon representation of the atomic model of the SARS-CoV-2 spike protein with an N-terminal VHH at epitope 1 (orange) on RBD down domain (red).

Figure 55B:
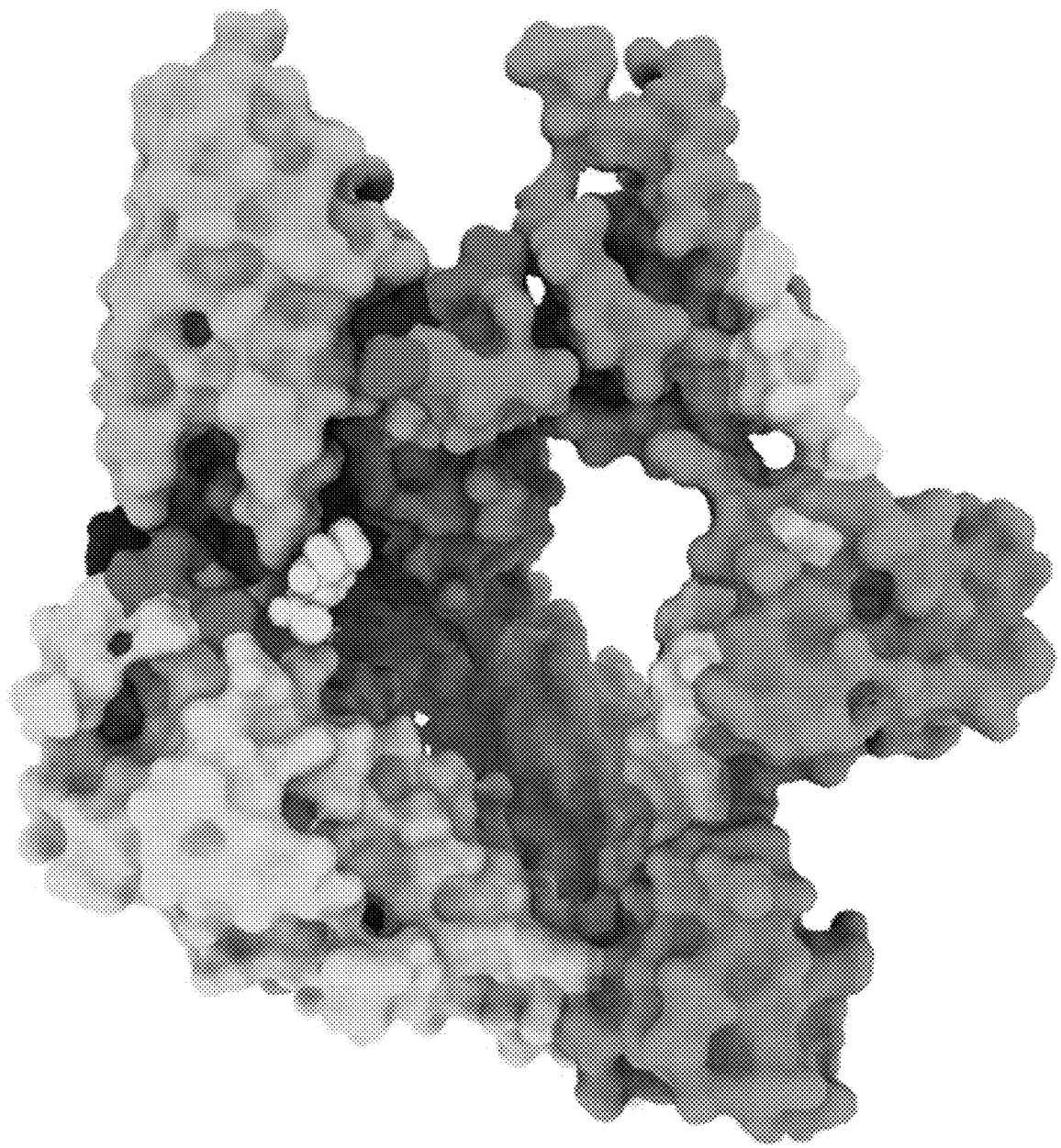

FIG. 55B shows a surface representation of the atomic model of SARS-CoV-2 spike protein with an N-terminal VHH at epitope 1 (orange) on RBD down domain (red).

Figure 56A:
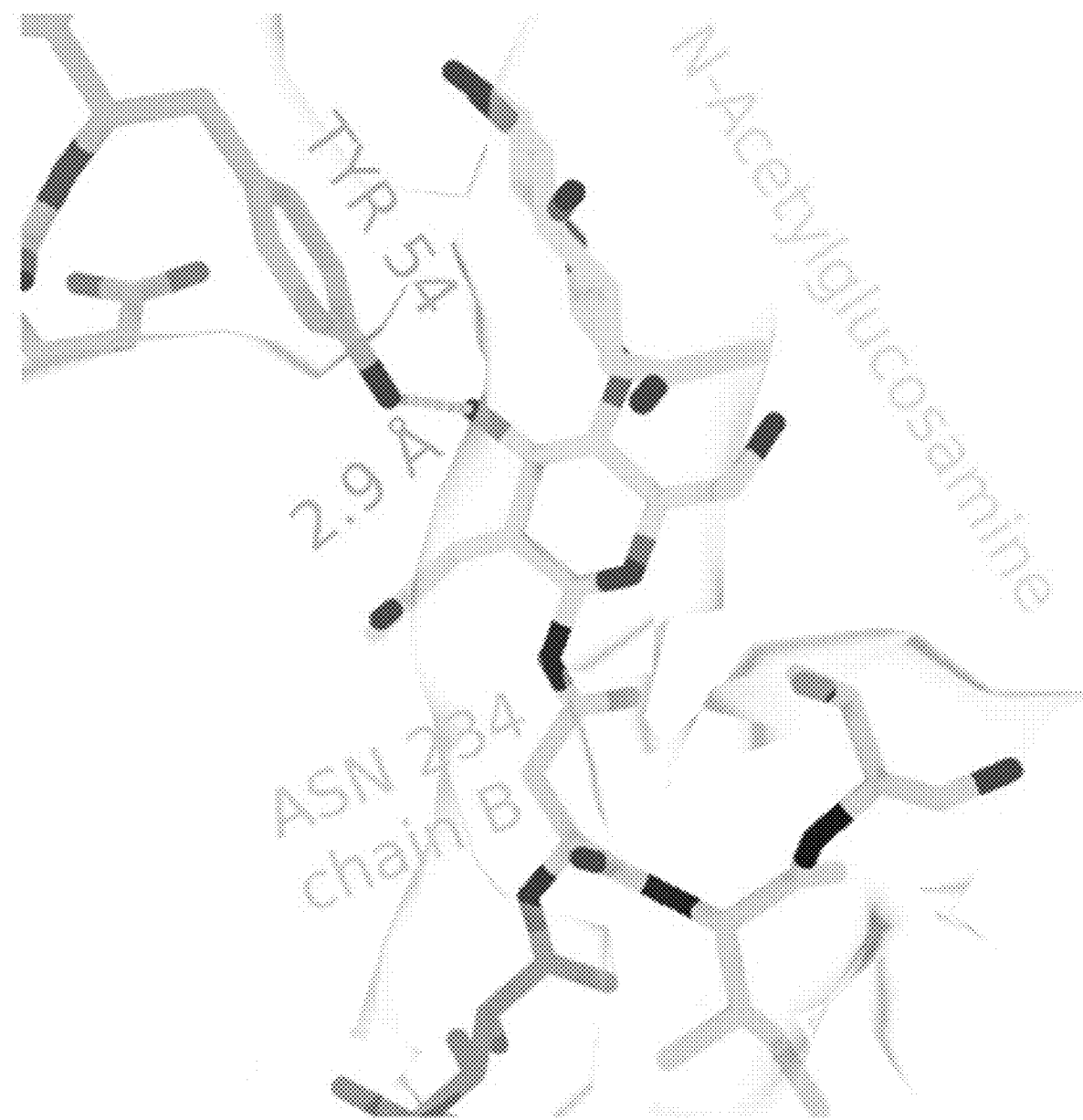

FIG. 56A shows glycosylation of the ASN 234 residue of the spike protein. The interaction of TYR54 of the VHH with the OH carbohydrate group was also verified. This suggests the importance of the ASN234 residue of the spike protein, which is glycosylated, in VHH binding.

Figure 56B:
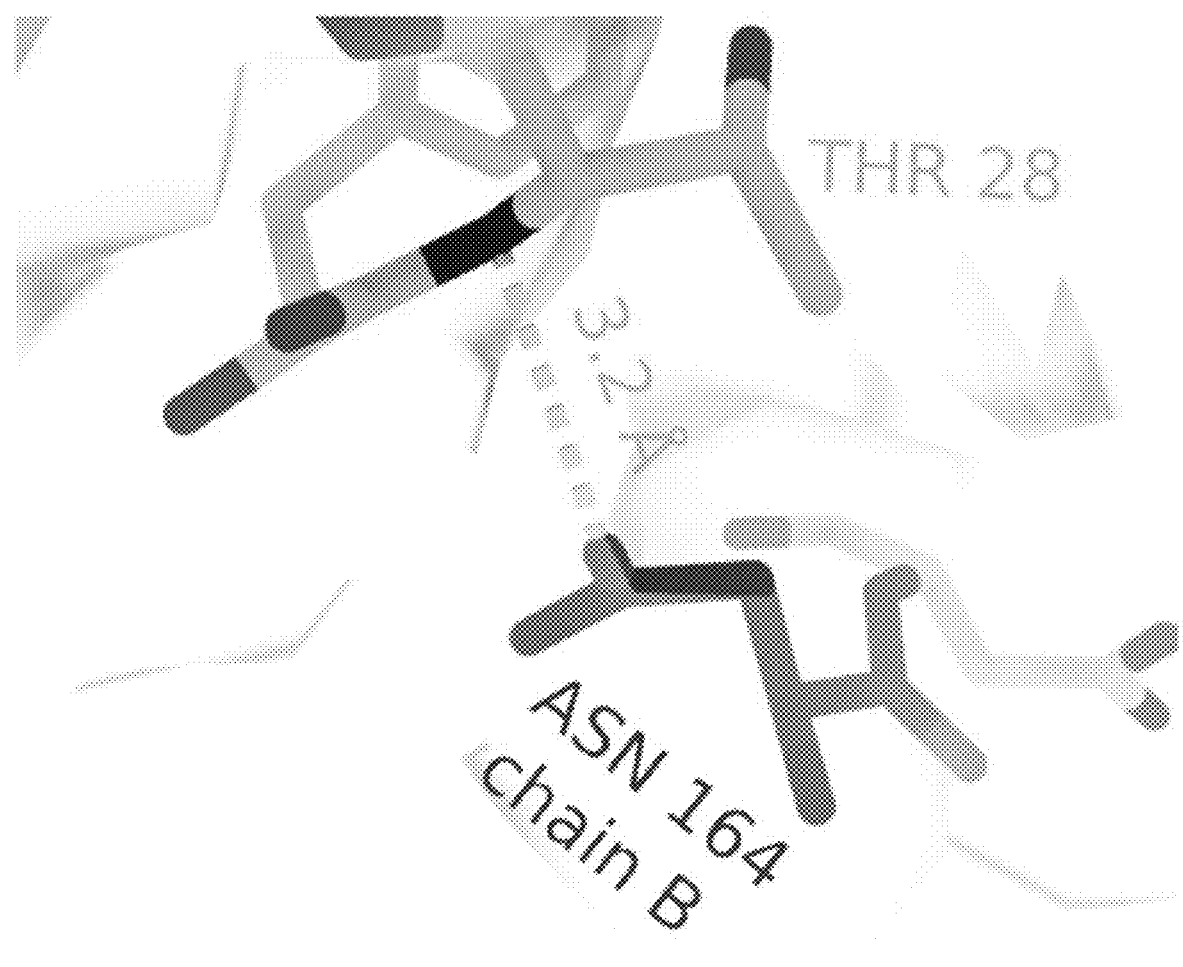

FIG. 56B shows verification of the interaction between the ASN164 residue of the spike protein sidechain and the backbone of the THR28 residue of the VHH using computational interfacing methods.

Figure 56C:
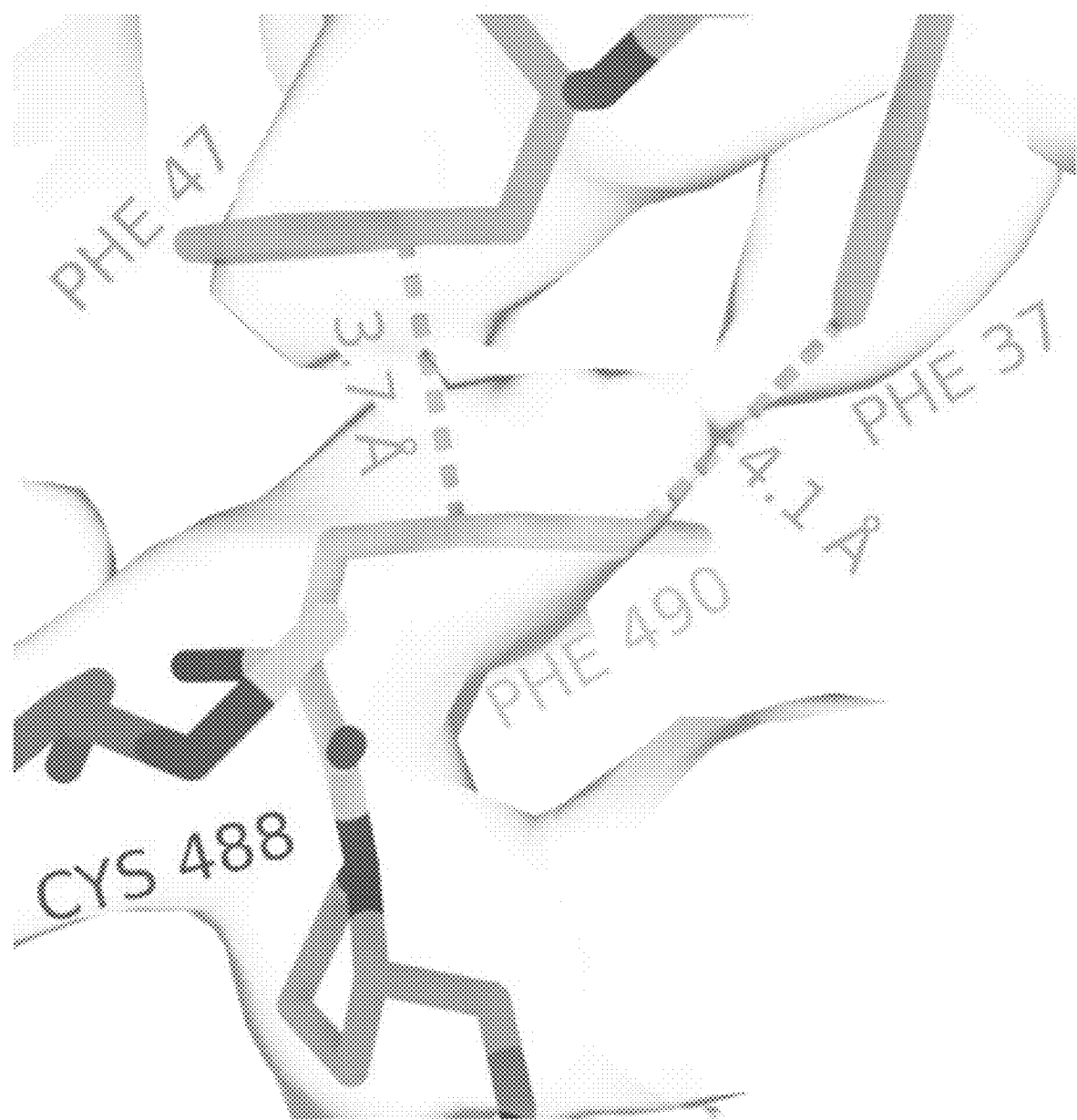

FIG. 56C shows the possible stacking interaction between the PHE490 residue of the spike protein and the PHE37 an PHE47 residues from VHH, which were suggested during manual model inspection. These findings are in agreement with results from mutagenesis studies of N-terminal VHH Ab.

Figure 56D:

FIG. 56D shows that residues ARG45 and TRP105 from the VHH interact with the sidechain (ARG45) and backbone (TRP105) of the ASN450 residue of the spike protein. These findings are in agreement with results from mutagenesis studies of N-terminal VHH Ab and highlights the importance of the ARG45:ASN450 interaction in the integrity of the spike:Ab complex.

Figure 56E:
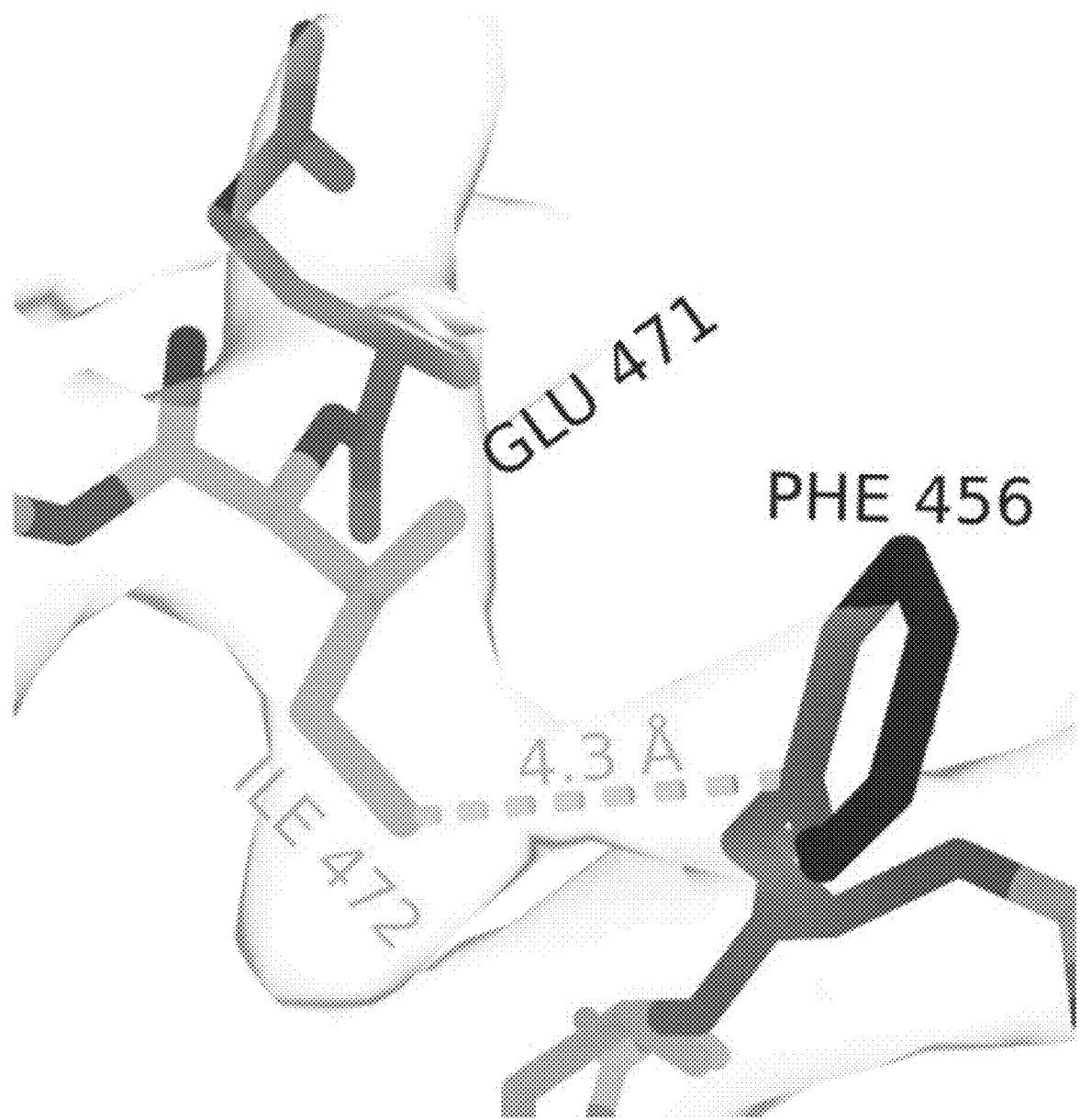
Figure 56F:
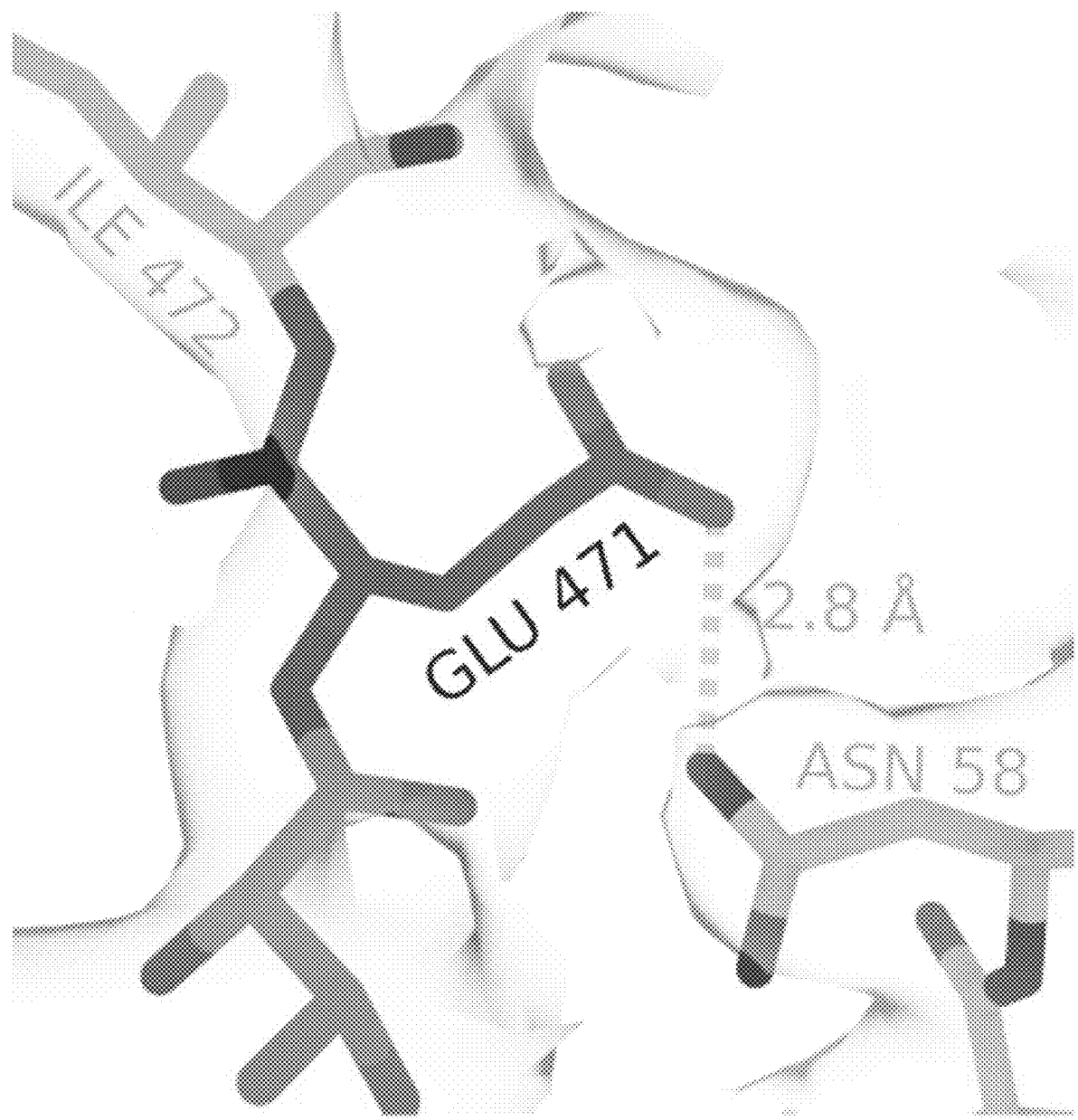

FIG. 56E shows that in epitope 1 the ILE472 reside of the spike protein does not interact with the VHH, but the GLU471 residue of the spike protein does interact with the VHH my means of a hydrogen bond with the ASN58 residue sidechain (FIG. 56F). The ILE472 residue of the spike protein strongly interacts with the PHE456 residue of the spike protein. This interaction could help maintain local spike protein folding.

FIG. 57A shows an epitope/paratope overview of epitope 2. FIG. 57B shows a list of explicit bonds. FIG. 57C shows a comparison to mutagenesis studies residue 472 was found to interact with the VHH based on manual inspection of the map and strong surrounding densities.

FIG. 58 shows a breakdown of the sequence of epitope 2. Figure discloses SEQ ID NO: 2679.

Figure 59A:
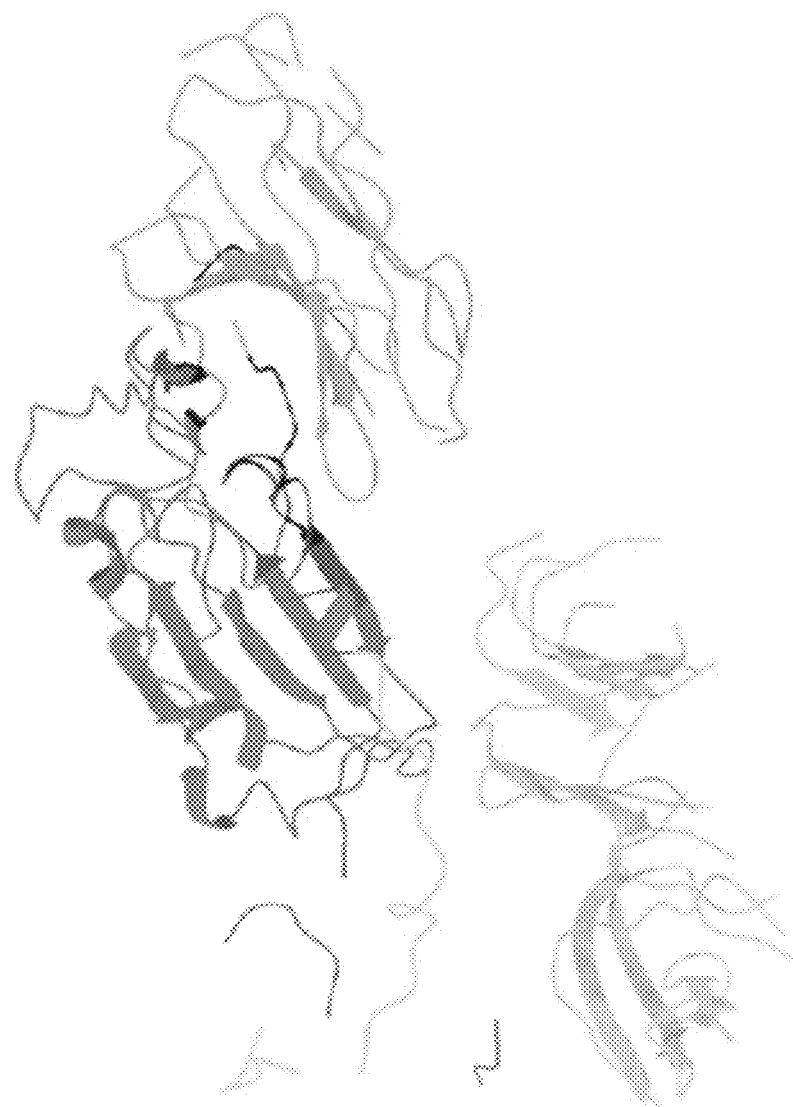
Figure 59B:
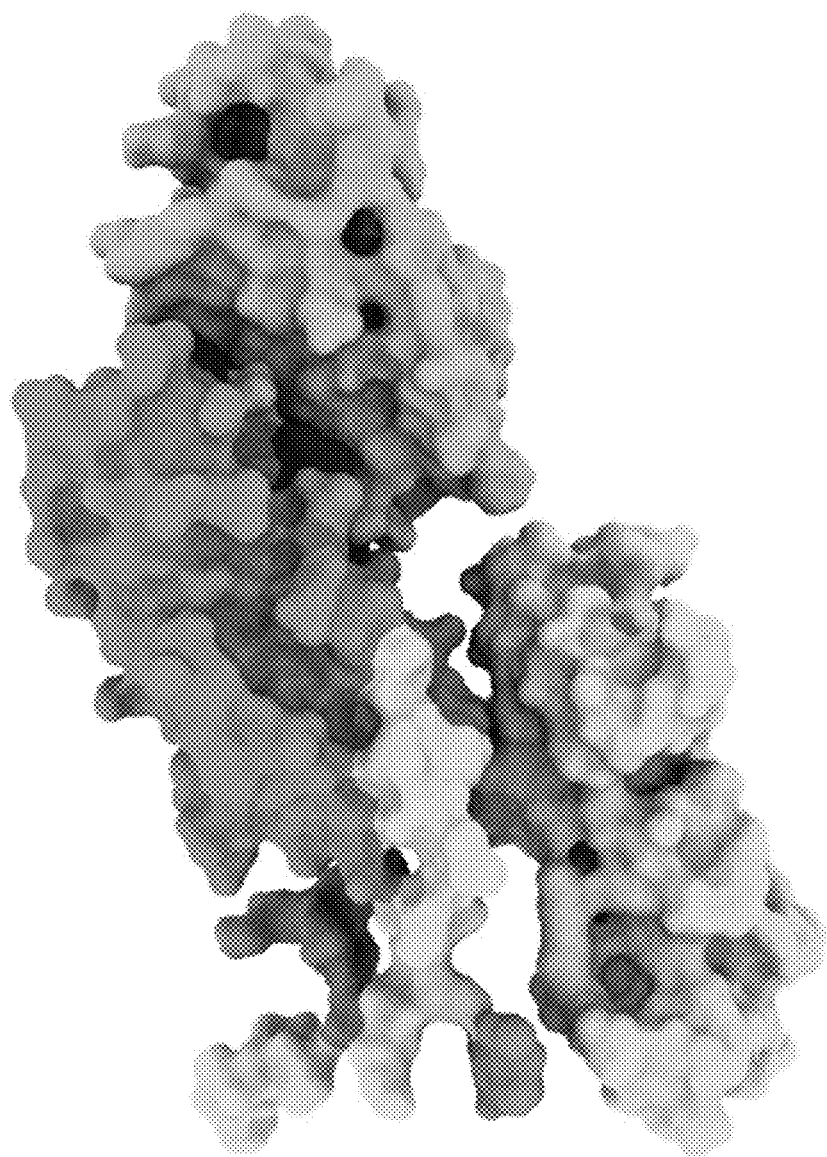

FIG. 59A shows a cartoon representation of the atomic model of the SARS-CoV-2 spike protein with an N-terminal VHH at epitope 2 (orange) on RBD up domain (red). FIG. 59B shows a surface representation of the atomic model of SARS-CoV-2 spike protein with an N-terminal VHH at epitope 2 (orange) on RBD up domain (red).

Figure 60A:
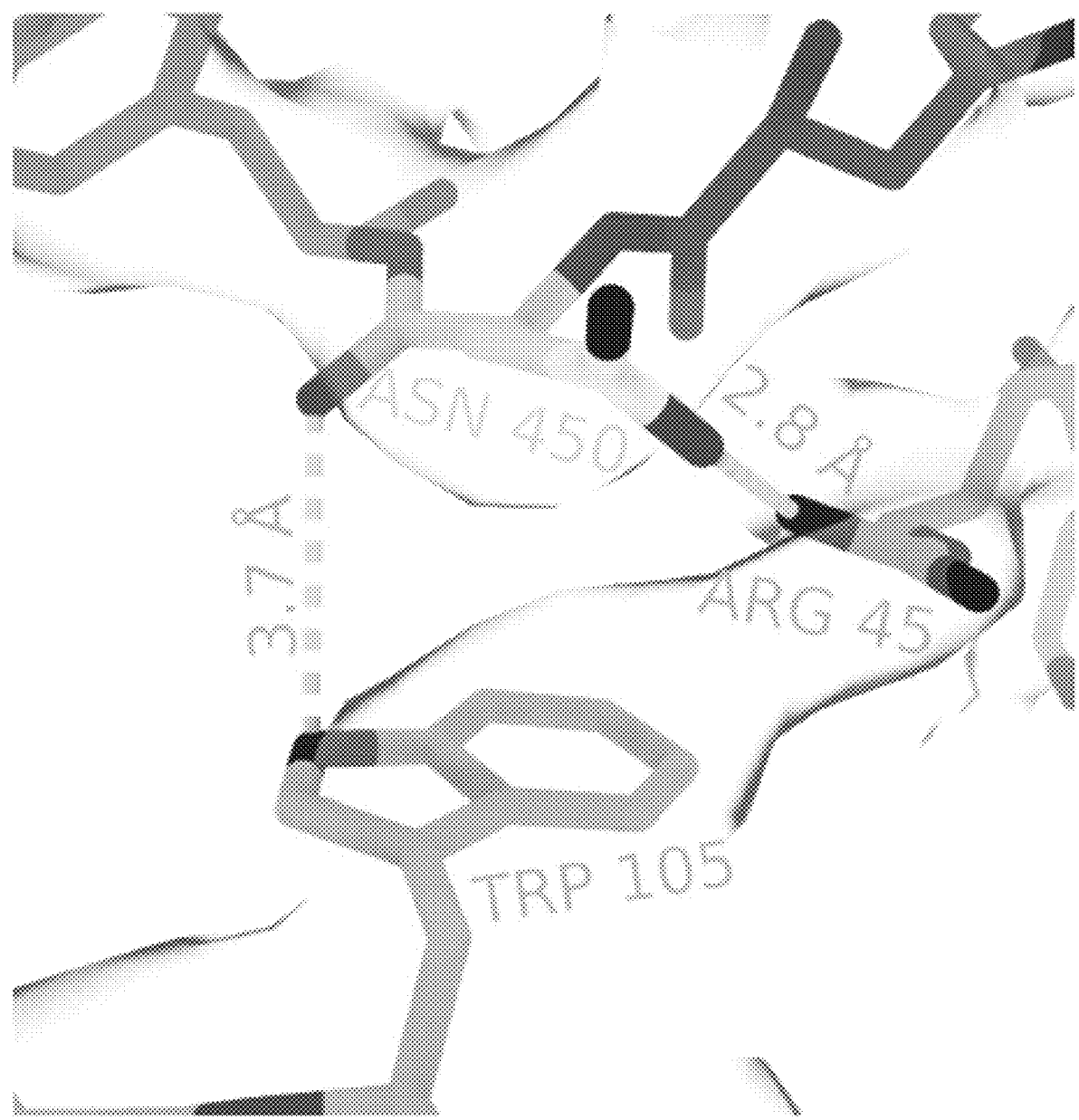

FIG. 60A shows that residue ASN450 of the spike protein interacts with both ARG45 and TRP105, both residues of VHH (high confidence interval). As only ARG45 is interacting with the ASN 450 sidechain, this suggests the ARG45-ASN450 bond is the more important bond. This data verifies the importance of ANS450 in interactions with SARS-CoV-2.

Figure 60B:
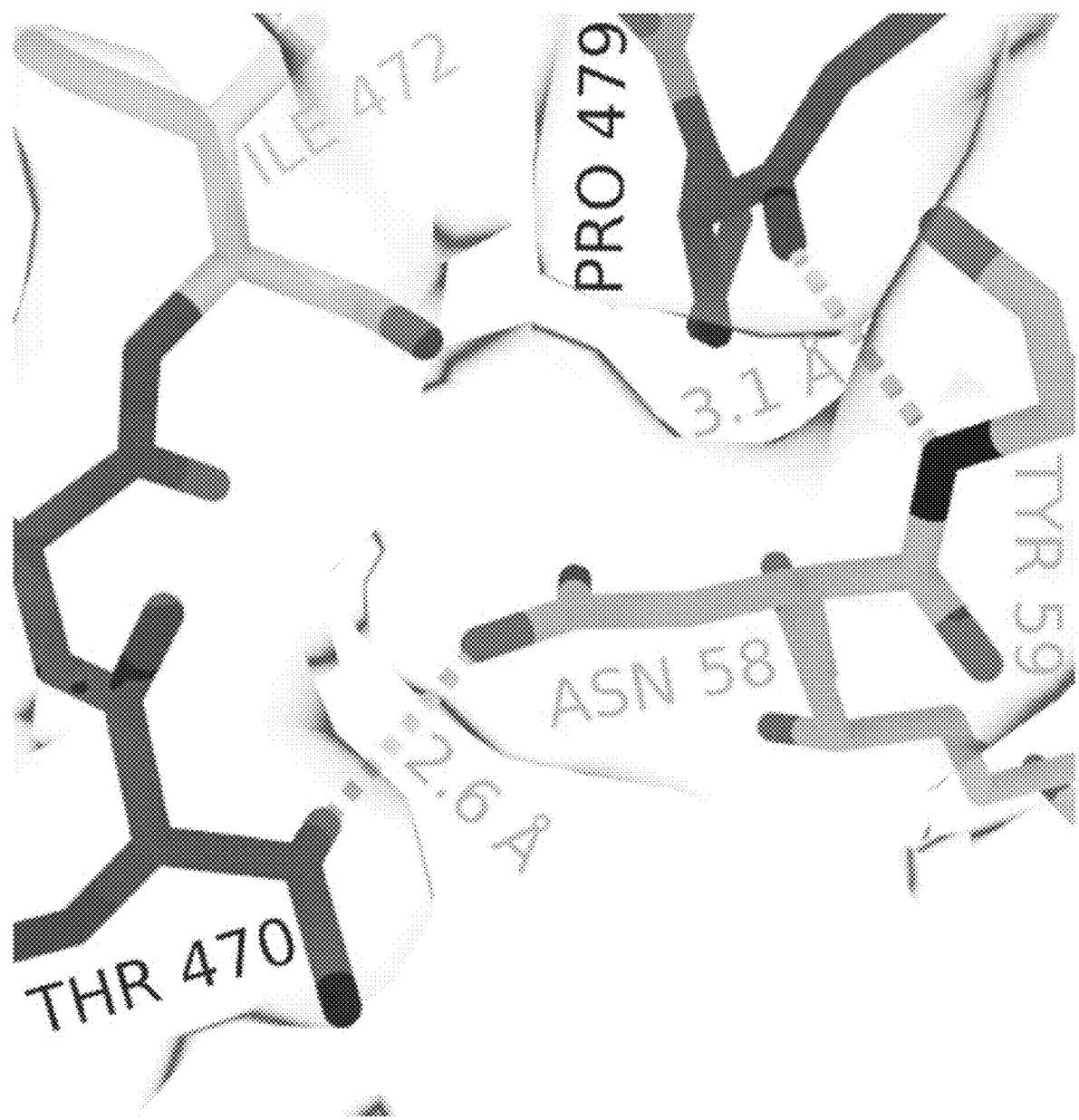

FIG. 60B shows that residue THR470 from the spike protein interacts with the backbone of residue TYR59. For residue ILE472, even though there was no discovered interaction, the cryEM map suggests that there is a strong interaction with VHH, probably also with ASN58. Therefore, THR470, PRO479, and IL472 can contribute to the interaction with VHH binding.

Figure 60C:
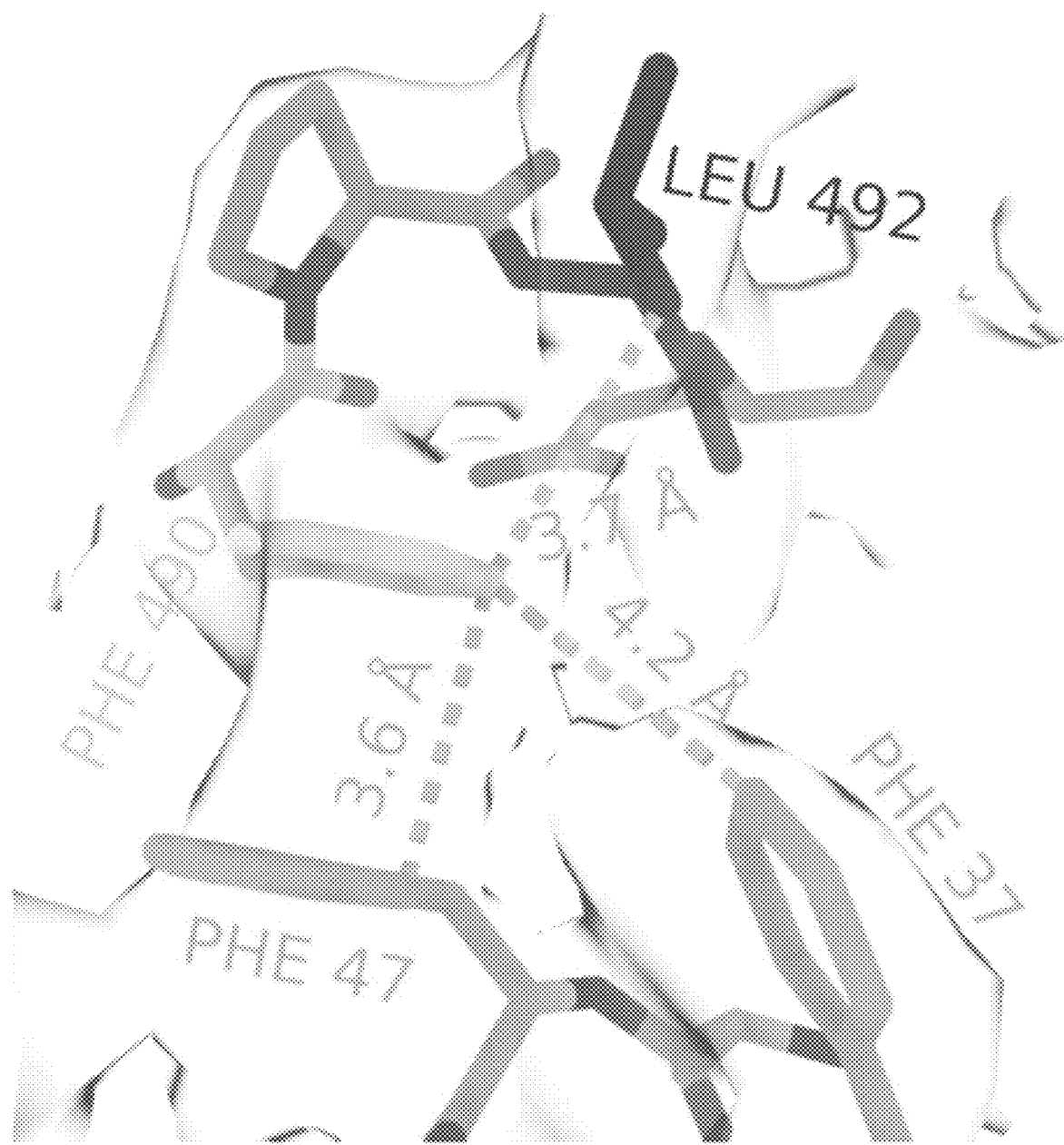

FIG. 60C shows that residue PHE490 of the spike protein has no automatically verified interaction. PHE490 appears to interact with PHE37 and PHE47 of the VHH using a stacking interaction and possibly with LEU492 through a hydrophobic interaction. The CryoEM studies verify PHE490 importance in VHH Ab binding.

Figure 60D:
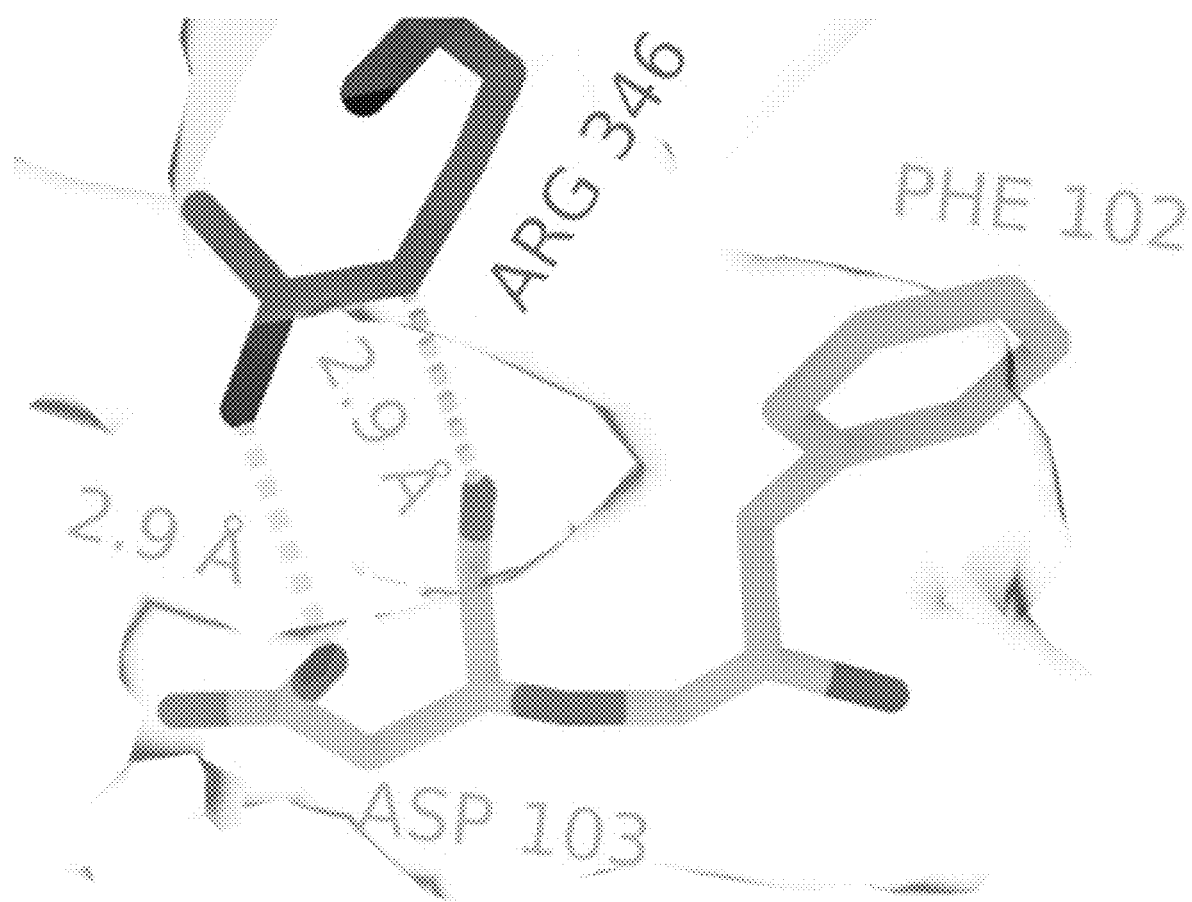

FIG. 60D shows that two hydrogen bonds were confirmed between ARG346 of the spike proteins and ASP103 of the VHH. Probably stacking interaction was also discovered between ARG346 and PHE102. ARG346 contributes to the interaction between the spike protein and the VHH antibody.

FIG. 61 shows a comparison of the VHH1 and VHH2 epitopes/paratopes.

Figure 62A:
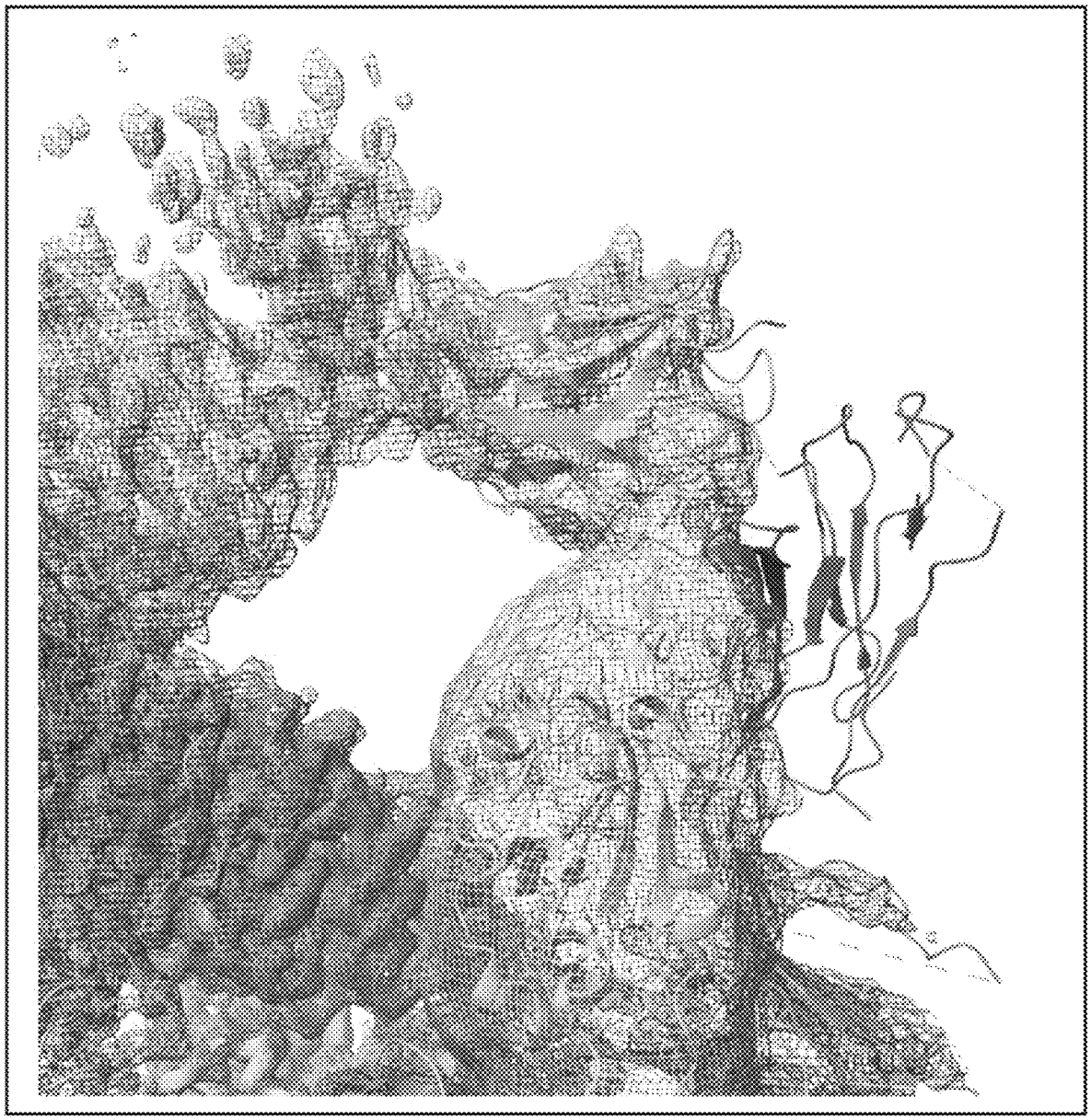

FIG. 62A shows that VHH3 (orange) assigned to the low-resolution density. It is positioned on top of the RBD up domain in a distinctly different position from the VHH1 or the VHH2. The blue portion shows the position as if VHH2 was at that location, supporting the different binding epitope. Pointing toward the constant fragment is the N-terminal of the VHH (i.e., GLU1).

Figure 62B:
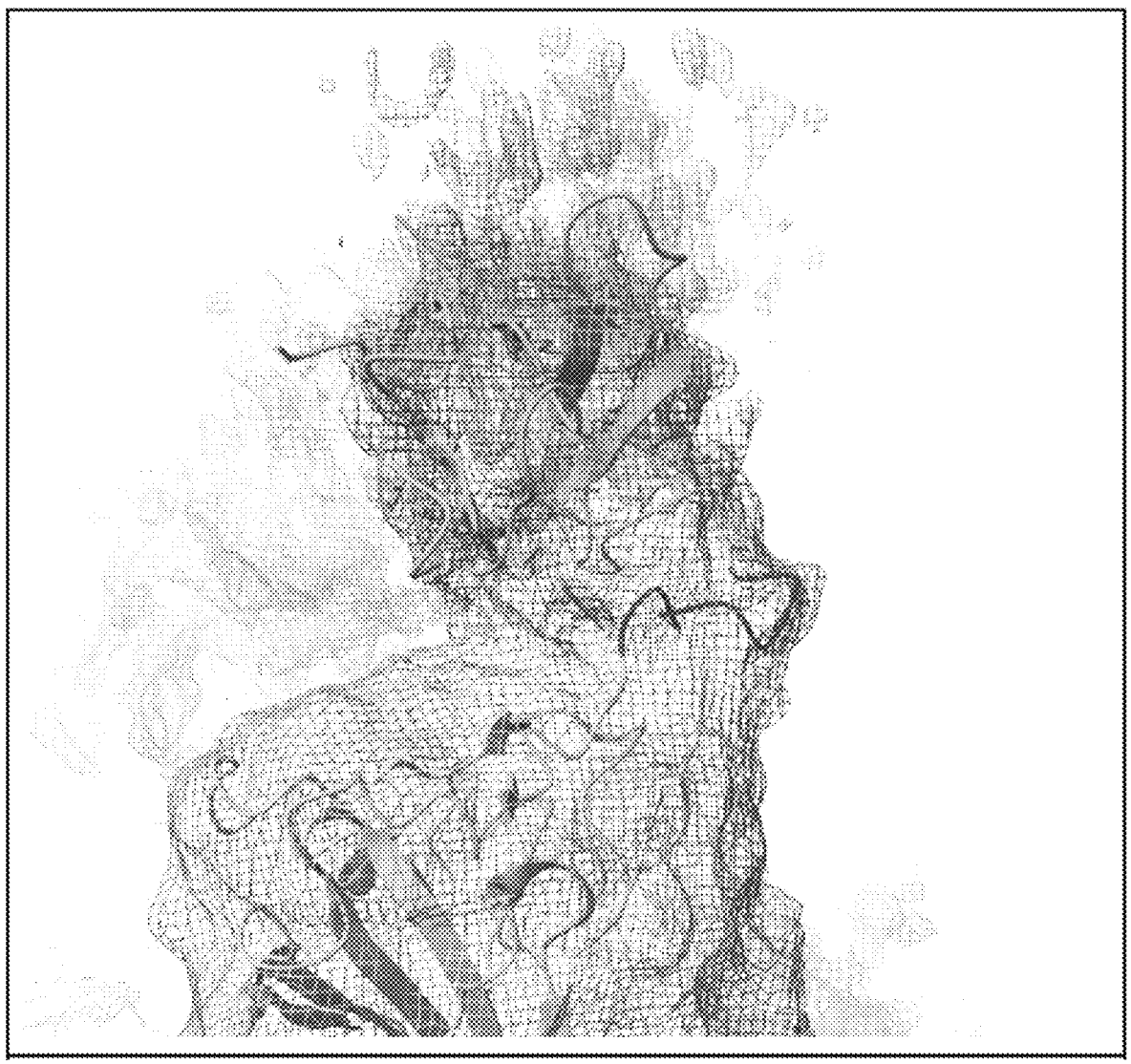

FIG. 62B shows further detail of the VHH3 from a side view. Mutagenesis studies suggest that for the C-term VHH, residues 476-489 are key for its interaction. These residues are marked red. Note, how these residues form a loop protruding up and sideways from the main body of the RBD (similar to the epitopes of VHH1 and 2) and how the VHH3 is very close to these residues while being a good distance away from the rest of the RBD up domain. We speculate that this is the reason for its more flexible binding compared to the VHH1 and VHH2—it interacts primarily with a probably flexible, protruding loop of the RBD, lacking more stabilizing contacts. Also this is further evidence supporting it being the C-term VHH. However, this assignment has been done only as a rigid body fitting of the RBD up domain modeled adjacent to position 2.

DETAILED DESCRIPTION

The present disclosure employs, unless otherwise indicated, conventional molecular biology techniques, which are within the skill of the art. Unless defined otherwise, all technical and scientific terms used herein have the same meaning as is commonly understood by one of ordinary skill in the art.

Definitions

Throughout this disclosure, various embodiments are presented in a range format. It should be understood that the description in range format is merely for convenience and brevity and should not be construed as an inflexible limitation on the scope of any embodiments. Accordingly, the description of a range should be considered to have specifically disclosed all the possible subranges as well as individual numerical values within that range to the tenth of the unit of the lower limit unless the context clearly dictates otherwise. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual values within that range, for example, 1.1, 2, 2.3, 5, and 5.9. This applies regardless of the breadth of the range. The upper and lower limits of these intervening ranges may independently be included in the smaller ranges, and are also encompassed within the disclosure, subject to any specifically excluded limit in the stated range. Where the stated range includes one or both of the limits, ranges excluding either or both of those included limits are also included in the disclosure, unless the context clearly dictates otherwise.

The terminology used herein is for the purpose of describing particular embodiments only and is not intended to be limiting of any embodiment. As used herein, the singular forms "a," "an" and "the" are intended to include the plural forms as well, unless the context clearly indicates otherwise. It will be further understood that the terms "comprises" and/or "comprising," when used in this specification, specify the presence of stated features, integers, steps, operations, elements, and/or components, but do not preclude the presence or addition of one or more other features, integers, steps, operations, elements, components, and/or groups thereof. As used herein, the term "and/or" includes any and all combinations of one or more of the associated listed items.

Unless specifically stated or obvious from context, as used herein, the term "about" in reference to a number or range of numbers is understood to mean the stated number and numbers +/−10% thereof, or 10% below the lower listed limit and 10% above the higher listed limit for the values listed for a range.

Unless specifically stated, as used herein, the term "nucleic acid" encompasses double- or triple-stranded nucleic acids, as well as single-stranded molecules. In double- or triple-stranded nucleic acids, the nucleic acid strands need not be coextensive (i.e., a double-stranded nucleic acid need not be double-stranded along the entire length of both strands). Nucleic acid sequences, when provided, are listed in the 5' to 3' direction, unless stated otherwise. Methods described herein provide for the generation of isolated nucleic acids. Methods described herein additionally provide for the generation of isolated and purified nucleic acids. A "nucleic acid" as referred to herein can comprise at least 5, 10, 20, 30, 40, 50, 60, 70, 80, 90, 100, 125, 150, 175, 200, 225, 250, 275, 300, 325, 350, 375, 400, 425, 450, 475, 500, 600, 700, 800, 900, 1000, 1100, 1200, 1300, 1400, 1500, 1600, 1700, 1800, 1900, 2000, or more bases in length. Moreover, provided herein are methods for the synthesis of any number of polypeptide-segments encoding nucleotide sequences, including sequences encoding non-ribosomal peptides (NRPs), sequences encoding non-ribosomal peptide-synthetase (NRPS) modules and synthetic variants, polypeptide segments of other modular proteins, such as antibodies, polypeptide segments from other protein families, including non-coding DNA or RNA, such as regulatory sequences e.g. promoters, transcription factors, enhancers, siRNA, shRNA, RNAi, miRNA, small nucleolar RNA derived from microRNA, or any functional or structural DNA or RNA unit of interest. The following are non-limiting examples of polynucleotides: coding or non-coding regions of a gene or gene fragment, intergenic DNA, loci (locus) defined from linkage analysis, exons, introns, messenger RNA (mRNA), transfer RNA, ribosomal RNA, short interfering RNA (siRNA), short-hairpin RNA (shRNA), micro-RNA (miRNA), small nucleolar RNA, ribozymes, complementary DNA (cDNA), which is a DNA representation of mRNA, usually obtained by reverse transcription of messenger RNA (mRNA) or by amplification; DNA molecules produced synthetically or by amplification, genomic DNA, recombinant polynucleotides, branched polynucleotides, plasmids, vectors, isolated DNA of any sequence, isolated RNA of any sequence, nucleic acid probes, and primers. cDNA encoding for a gene or gene fragment referred herein may comprise at least one region encoding for exon sequences without an intervening intron sequence in the genomic equivalent sequence. cDNA described herein may be generated by de novo synthesis.

Antibody Optimization Library for Coronavirus

Provided herein are methods, compositions, and systems for the optimization of antibodies for coronavirus. In some embodiments, the antibodies are optimized for SARS-CoV, MERS-CoV, CoV-229E, HCoV-NL63, HCoV—OC43, or HCoV—HKU1. In some embodiments, the antibodies are optimized for SARS-CoV-2. In some embodiments, the antibodies are optimized for a receptor that binds to the coronavirus. In some embodiments, the receptor of the coronavirus is ACE2 or dipeptidyl peptidase 4 (DPP4). In some embodiments, the antibodies are optimized based on interactions between the coronavirus and the receptor that binds the coronavirus. In some embodiments, the antibodies are optimized for angiotensin-converting enzyme 2 (ACE2). In some embodiments, the antibodies are optimized based on interactions between SARS-CoV-2 and ACE2.

Antibodies are in some instances optimized by the design of in-silico libraries comprising variant sequences of an input antibody sequence (FIG. 1). Input sequences 100 are in some instances modified in-silico 102 with one or more mutations or variants to generate libraries of optimized sequences 103. In some instances, such libraries are synthesized, cloned into expression vectors, and translation products (antibodies) evaluated for activity. In some instances, fragments of sequences are synthesized and subsequently assembled. In some instances, expression vectors are used to display and enrich desired antibodies, such as phage display. Selection pressures used during enrichment in some instances includes, but is not limited to, binding affinity, toxicity, immunological tolerance, stability, receptor-ligand competition, or developability. Such expression vectors allow antibodies with specific properties to be selected ("panning"), and subsequent propagation or amplification of such sequences enriches the library with these sequences. Panning rounds can be repeated any number of times, such as 1, 2, 3, 4, 5, 6, 7, or more than 7 rounds. Sequencing at one or more rounds is in some instances used to identify which sequences 105 have been enriched in the library.

Described herein are methods and systems of in-silico library design. For example, an antibody or antibody fragment sequence is used as input. In some instances, the antibody sequence used as input is an antibody or antibody fragment sequence that binds SARS-CoV-2. In some instances, the input is an antibody or antibody fragment sequence that binds a protein of SARS-CoV-2. In some instances, the protein is a spike glycoprotein, a membrane protein, an envelope protein, a nucleocapsid protein, or combinations thereof. In some instances, the protein is a spike glycoprotein of SARS-CoV-2. In some instances, the protein is a receptor binding domain of SARS-CoV-2. In some instances, the input sequence is an antibody or antibody fragment sequence that binds angiotensin-converting enzyme 2 (ACE2). In some instances, the input sequence is an antibody or antibody fragment sequence that binds an extracellular domain of the angiotensin-converting enzyme 2 (ACE2).

A database 102 comprising known mutations or variants of one or more viruses is queried 101, and a library 103 of sequences comprising combinations of these mutations or variants are generated. In some instances, the database comprises known mutations or variants of SARS-CoV-like coronaviruses, SARS-CoV-2, SARS-CoV, or combinations thereof. In some instances, the database comprises known mutations or variants of the spike protein of SARS-CoV-like coronaviruses, SARS-CoV-2, SARS-CoV, or combinations thereof. In some instances, the database comprises known mutations or variants of the receptor binding domain of SARS-CoV-like coronaviruses, SARS-CoV-2, SARS-CoV, or combinations thereof. In some instances, the database comprises mutations or variants of a protein of SARS-CoV-like coronaviruses, SARS-CoV-2, SARS-CoV, or combinations thereof that binds to ACE2.

In some instances, the input sequence is a heavy chain sequence of an antibody or antibody fragment that binds SARS-CoV-like coronaviruses, SARS-CoV-2, SARS-CoV, or combinations thereof. In some instances, the input sequence is a light chain sequence of an antibody or antibody fragment that binds SARS-CoV-like coronaviruses, SARS-CoV-2, SARS-CoV, or combinations thereof. In some instances, the heavy chain sequence comprises varied CDR regions. In some instances, the light chain sequence comprises varied CDR regions. In some instances, known mutations or variants from CDRs are used to build the sequence library. Filters 104, or exclusion criteria, are in some instances used to select specific types of variants for members of the sequence library. For example, sequences having a mutation or variant are added if a minimum number of organisms in the database have the mutation or variant. In some instances, additional CDRs are specified for inclusion in the database. In some instances, specific mutations or variants or combinations of mutations or variants are excluded from the library (e.g., known immunogenic sites, structure sites, etc.). In some instances, specific sites in the input sequence are systematically replaced with histidine, aspartic acid, glutamic acid, or combinations thereof. In some instances, the maximum or minimum number of mutations or variants allowed for each region of an antibody are specified. Mutations or variants in some instances are described relative to the input sequence or the input sequence's corresponding germline sequence. For example, sequences generated by the optimization comprise at least 1, 2, 3, 4, 5, 6, 7, 8, 9, 10, 11, 12, 13, 14, 15, 16, or more than 16 mutations or variants from the input sequence. In some instances, sequences generated by the optimization comprise no more than 1, 2, 3, 4, 5, 6, 7, 8, 9, 10, 11, 12, 13, 14, 15, 16, or no more than 18 mutations or variants from the input sequence. In some instances, sequences generated by the optimization comprise about 1, 2, 3, 4, 5, 6, 7, 8, 9, 10, 11, 12, 13, 14, 15, 16, or about 18 mutations or variants relative to the input sequence. In some instances, sequences generated by the optimization comprise about 1, 2, 3, 4, 5, 6, or 7 mutations or variants from the input sequence in a first CDR region. In some instances, sequences generated by the optimization comprise about 1, 2, 3, 4, 5, 6, or 7 mutations or variants from the input sequence in a second CDR region. In some instances, sequences generated by the optimization comprise about 1, 2, 3, 4, 5, 6, or 7 mutations or variants from the input sequence in a third CDR region. In some instances, sequences generated by the optimization comprise about 1, 2, 3, 4, 5, 6, or 7 mutations or variants from the input sequence in a first CDR region of a heavy chain. In some instances, sequences generated by the optimization comprise about 1, 2, 3, 4, 5, 6, or 7 mutations or variants from the input sequence in a second CDR region of a heavy chain. In some instances, sequences generated by the optimization comprise about 1, 2, 3, 4, 5, 6, or 7 mutations or variants from the input sequence in a third CDR region of a heavy chain. In some instances, sequences generated by the optimization comprise about 1, 2, 3, 4, 5, 6, or 7 mutations or variants from the input sequence in a first CDR region of a light chain. In some instances, sequences generated by the optimization comprise about 1, 2, 3, 4, 5, 6, or 7 mutations or variants from the input sequence in a second CDR region of a light chain. In some instances, sequences generated by the optimization comprise about 1, 2, 3, 4, 5, 6, or 7 mutations or variants from the input sequence in a third CDR region of a light chain. In some instances, a first CDR region is CDR1. In some instances, a second CDR region is CDR2. In some instances, a third CDR region is CDR3. In-silico antibodies libraries are in some instances synthesized, assembled, and enriched for desired sequences.

The germline sequences corresponding to an input sequence may also be modified to generate sequences in a library. For example, sequences generated by the optimization methods described herein comprise at least 1, 2, 3, 4, 5, 6, 7, 8, 9, 10, 11, 12, 13, 14, 15, 16, or more than 16 mutations or variants from the germline sequence. In some instances, sequences generated by the optimization comprise no more than 1, 2, 3, 4, 5, 6, 7, 8, 9, 10, 11, 12, 13, 14, 15, 16, or no more than 18 mutations or variants from the germline sequence. In some instances, sequences generated by the optimization comprise about 1, 2, 3, 4, 5, 6, 7, 8, 9, 10, 11, 12, 13, 14, 15, 16, or about 18 mutations or variants relative to the germline sequence.

Provided herein are methods, systems, and compositions for antibody optimization, wherein the input sequence comprises mutations or variants in an antibody region. Exemplary regions of the antibody include, but are not limited to, a complementarity-determining region (CDR), a variable domain, or a constant domain. In some instances, the CDR is CDR1, CDR2, or CDR3. In some instances, the CDR is a heavy domain including, but not limited to, CDRH1, CDRH2, and CDRH3. In some instances, the CDR is a light domain including, but not limited to, CDRL1, CDRL2, and CDRL3. In some instances, the variable domain is variable domain, light chain (VL) or variable domain, heavy chain (VH). In some instances, the VL domain comprises kappa or lambda chains. In some instances, the constant domain is constant domain, light chain (CL) or constant domain, heavy chain (CH). In some instances, sequences generated by the optimization comprise about 1, 2, 3, 4, 5, 6, or 7 mutations or variants from the germline sequence in a first CDR region. In some instances, sequences generated by the optimization comprise about 1, 2, 3, 4, 5, 6, or 7 mutations or variants from the germline sequence in a second CDR region. In some instances, sequences generated by the optimization comprise about 1, 2, 3, 4, 5, 6, or 7 mutations or variants from the germline sequence in a third CDR region. In some instances, sequences generated by the optimization comprise about 1, 2, 3, 4, 5, 6, or 7 mutations or variants from the germline sequence in a first CDR region of a heavy chain. In some instances, sequences generated by the optimization comprise about 1, 2, 3, 4, 5, 6, or 7 mutations or variants from the germline sequence in a second CDR region of a heavy chain. In some instances, sequences generated by the optimization comprise about 1, 2, 3, 4, 5, 6, or 7 mutations or variants from the germline sequence in a third CDR region of a heavy chain. In some instances, sequences generated by the optimization comprise about 1, 2, 3, 4, 5, 6, or 7 mutations or variants from the germline sequence in a first CDR region of a light chain. In some instances, sequences generated by the optimization comprise about 1, 2, 3, 4, 5, 6, or 7 mutations or variants from the germline sequence in a second CDR region of a light chain. In some instances, sequences generated by the optimization comprise about 1, 2, 3, 4, 5, 6, or 7 mutations or variants from the germline sequence in a third CDR region of a light chain. In some instances, a first CDR region is CDR1. In some instances, a second CDR region is CDR2. In some instances, a third CDR region is CDR3.

VHH Libraries

Provided herein are methods, compositions, and systems for generation of antibodies or antibody fragments. In some instances, the antibodies or antibody fragments are single domain antibodies. Methods, compositions, and systems described herein for the optimization of antibodies comprise a ratio-variant approach that mirror the natural diversity of antibody sequences. In some instances, libraries of optimized antibodies comprise variant antibody sequences. In some instances, the variant antibody sequences are designed comprising variant CDR regions. In some instances, the variant antibody sequences comprising variant CDR regions are generated by shuffling the natural CDR sequences in a llama, humanized, or chimeric framework. In some instances, such libraries are synthesized, cloned into expression vectors, and translation products (antibodies) evaluated for activity. In some instances, fragments of sequences are synthesized and subsequently assembled. In some instances, expression vectors are used to display and enrich desired antibodies, such as phage display. In some instances, the phage vector is a Fab phagemid vector. Selection pressures used during enrichment in some instances includes, but is not limited to, binding affinity, toxicity, immunological tolerance, stability, receptor-ligand competition, or developability. Such expression vectors allow antibodies with specific properties to be selected ("panning"), and subsequent propagation or amplification of such sequences enriches the library with these sequences. Panning rounds can be repeated any number of times, such as 1, 2, 3, 4, 5, 6, 7, or more than 7 rounds. In some instances, each round of panning involves a number of washes. In some instances, each round of panning involves at least or about 1, 2, 3, 4, 5, 6, 7, 8, 9, 10, 11, 12, 13, 14, 15, 16, or more than 16 washes.

Described herein are methods and systems of in-silico library design. Libraries as described herein, in some instances, are designed based on a database comprising a variety of antibody sequences. In some instances, the database comprises a plurality of variant antibody sequences against various targets. In some instances, the database comprises at least 100, 500, 1000, 1500, 2000, 2500, 3000, 3500, 4000, 4500, 5000, or more than 5000 antibody sequences. An exemplary database is an iCAN database. In some instances, the database comprises naïve and memory B-cell receptor sequences. In some instances, the naïve and memory B-cell receptor sequences are human, mouse, or primate sequences. In some instances, the naïve and memory B-cell receptor sequences are human sequences. In some instances, the database is analyzed for position specific variation. In some instances, antibodies described herein comprise position specific variations in CDR regions. In some instances, the CDR regions comprise multiple sites for variation.

Described herein are libraries comprising variation in a CDR region. In some instances, the CDR is CDR1, CDR2, or CDR3 of a variable heavy chain. In some instances, the CDR is CDR1, CDR2, or CDR3 of a variable light chain. In some instances, the libraries comprise multiple variants encoding for CDR1, CDR2, or CDR3. In some instances, the libraries as described herein encode for at least 50, 100, 200, 300, 400, 500, 1000, 1200, 1500, 1700, 2000, 2500, 3000, 3500, 4000, 4500, 5000, or more than 5000 CDR1 sequences. In some instances, the libraries as described herein encode for at least 50, 100, 200, 300, 400, 500, 1000, 1200, 1500, 1700, 2000, 2500, 3000, 3500, 4000, 4500, 5000, or more than 5000 CDR2 sequences. In some instances, the libraries as described herein encode for at least 50, 100, 200, 300, 400, 500, 1000, 1200, 1500, 1700, 2000, 2500, 3000, 3500, 4000, 4500, 5000, or more than 5000 CDR3 sequences. In-silico antibodies libraries are in some instances synthesized, assembled, and enriched for desired sequences.

Following synthesis of CDR1 variants, CDR2 variants, and CDR3 variants, in some instances, the CDR1 variants, the CDR2 variants, and the CDR3 variants are shuffled to generate a diverse library. In some instances, the diversity of the libraries generated by methods described herein have a theoretical diversity of at least or about $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, or more than $10^{18}$ sequences. In some instances, the library has a final library diversity of at least or about $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, or more than $10^{18}$ sequences.

The germline sequences corresponding to a variant sequence may also be modified to generate sequences in a library. For example, sequences generated by methods described herein comprise at least 1, 2, 3, 4, 5, 6, 7, 8, 9, 10, 11, 12, 13, 14, 15, 16, or more than 16 mutations or variants from the germline sequence. In some instances, sequences generated comprise no more than 1, 2, 3, 4, 5, 6, 7, 8, 9, 10, 11, 12, 13, 14, 15, 16, or no more than 18 mutations or variants from the germline sequence. In some instances, sequences generated comprise about 1, 2, 3, 4, 5, 6, 7, 8, 9, 10, 11, 12, 13, 14, 15, 16, or about 18 mutations or variants relative to the germline sequence.

Coronavirus Antibody Libraries

Provided herein are libraries generated from antibody optimization methods described herein. Antibodies described herein result in improved functional activity, structural stability, expression, specificity, or a combination thereof.

Provided herein are methods and compositions relating to SARS-CoV-2 binding libraries comprising nucleic acids encoding for a SARS-CoV-2 antibody. Further provided herein are methods and compositions relating to ACE2 binding libraries comprising nucleic acids encoding for an ACE2 antibody. Such methods and compositions in some instances are generated by the antibody optimization methods and systems described herein. Libraries as described herein may be further variegated to provide for variant libraries comprising nucleic acids each encoding for a predetermined variant of at least one predetermined reference nucleic acid sequence. Further described herein are protein libraries that may be generated when the nucleic acid libraries are translated. In some instances, nucleic acid libraries as described herein are transferred into cells to generate a cell library. Also provided herein are downstream applications for the libraries synthesized using methods described herein. Downstream applications include identification of variant nucleic acids or protein sequences with enhanced biologically relevant functions, e.g., improved stability, affinity, binding, functional activity, and for the treatment or prevention of an infection caused by a coronavirus such as SARS-CoV-2.

In some instances, an antibody or antibody fragment described herein comprises a sequence of any one of SEQ ID NOs: 1-2668. In some instances, an antibody or antibody fragment described herein comprises a sequence that is at least 80% identical to a sequence of any one of SEQ ID NOs: 1-2668. In some instances, an antibody or antibody fragment described herein comprises a sequence that is at least 85% identical to a sequence of any one of SEQ ID NOs: 1-2668. In some instances, an antibody or antibody fragment described herein comprises a sequence that is at least 90% identical to a sequence of any one of SEQ ID NOs: 1-2668. In some instances, an antibody or antibody fragment described herein comprises a sequence that is at least 95% identical to a sequence of any one of SEQ ID NOs: 1-2668.

In some instances, an antibody or antibody fragment described herein comprises a CDRH1 sequence of any one of SEQ ID NOs: 151-165, 241-255, 331-357, and 547-575. In some instances, an antibody or antibody fragment described herein comprises a sequence that is at least 80% identical to a CDRH1 sequence of any one of SEQ ID NOs: 151-165, 241-255, 331-357, and 547-575. In some instances, an antibody or antibody fragment described herein comprises a sequence that is at least 85% identical to a CDRH1 sequence of any one of SEQ ID NOs: 151-165, 241-255, 331-357, and 547-575. In some instances, an antibody or antibody fragment described herein comprises a sequence that is at least 90% identical to a CDRH1 sequence of any one of SEQ ID NOs: 151-165, 241-255, 331-357, and 547-575. In some instances, an antibody or antibody fragment described herein comprises a sequence that is at least 95% identical to a CDRH1 sequence of any one of SEQ ID NOs: 151-165, 241-255, 331-357, and 547-575. In some instances, an antibody or antibody fragment described herein comprises a CDRH2 sequence of any one of SEQ ID NOs: 166-180, 256-270, 358-384, and 576-604. In some instances, an antibody or antibody fragment described herein comprises a sequence that is at least 80% identical to a CDRH2 sequence of any one of SEQ ID NOs: 166-180, 256-270, 358-384, and 576-604. In some instances, an antibody or antibody fragment described herein comprises a sequence that is at least 85% identical to a CDRH2 sequence of any one of SEQ ID NOs: 166-180, 256-270, 358-384, and 576-604. In some instances, an antibody or antibody fragment described herein comprises a sequence that is at least 90% identical to a CDRH2 sequence of any one of SEQ ID NOs: 166-180, 256-270, 358-384, and 576-604. In some instances, an antibody or antibody fragment described herein comprises a sequence that is at least 95% identical to a CDRH2 sequence of any one of SEQ ID NOs: 166-180, 256-270, 358-384, and 576-604. In some instances, an antibody or antibody fragment described herein comprises a CDRH3 sequence of any one of SEQ ID NOs: 181-195, 271-285, 385-411, and 605-633. In some instances, an antibody or antibody fragment described herein comprises a sequence that is at least 80% identical to a CDRH3 sequence of any one of SEQ ID NOs: 181-195, 271-285, 385-411, and 605-633. In some instances, an antibody or antibody fragment described herein comprises a sequence that is at least 85% identical to a CDRH3 sequence of any one of SEQ ID NOs: 181-195, 271-285, 385-411, and 605-633. In some instances, an antibody or antibody fragment described herein comprises a sequence that is at least 90% identical to a CDRH3 sequence of any one of SEQ ID NOs: 181-195, 271-285, 385-411, and 605-633. In some instances, an antibody or antibody fragment described herein comprises a sequence that is at least 95% identical to a CDRH3 sequence of any one of SEQ ID NOs: 181-195, 271-285, 385-411, and 605-633.

In some instances, an antibody or antibody fragment described herein comprises a CDRH1 sequence of any one of SEQ ID NOs: 1-50, 779-919, 1344-1523, and 2381-2452. In some instances, an antibody or antibody fragment described herein comprises a sequence that is at least 80% identical to a CDRH1 sequence of any one of SEQ ID NOs: 1-50, 779-919, 1344-1523, and 2381-2452. In some instances, an antibody or antibody fragment described herein comprises a sequence that is at least 85% identical to a CDRH1 sequence of any one of SEQ ID NOs: 1-50, 779-919, 1344-1523, and 2381-2452. In some instances, an antibody or antibody fragment described herein comprises a sequence that is at least 90% identical to a CDRH1 sequence of any one of SEQ ID NOs: 1-50, 779-919, 1344-1523, and 2381-2452. In some instances, an antibody or antibody fragment described herein comprises a sequence that is at least 95% identical to a CDRH1 sequence of any one of SEQ ID NOs: 1-50, 779-919, 1344-1523, and 2381-2452. In some instances, an antibody or antibody fragment described herein comprises a CDRH2 sequence of any one of SEQ ID NOs: 51-100, 920-1061, 1524-1703, and 2453-2524. In some instances, an antibody or antibody fragment described herein comprises a sequence that is at least 80% identical to a CDRH2 sequence of any one of SEQ ID NOs: 51-100, 920-1061, 1524-1703, and 2453-2524. In some instances, an antibody or antibody fragment described herein comprises a sequence that is at least 85% identical to a CDRH2 sequence of any one of SEQ ID NOs: 51-100, 920-1061, 1524-1703, and 2453-2524. In some instances, an antibody or antibody fragment described herein comprises a sequence that is at least 90% identical to a CDRH2 sequence of any one of SEQ ID NOs: 51-100, 920-1061, 1524-1703, and 2453-2524. In some instances, an antibody or antibody fragment described herein comprises a sequence that is at least 95% identical to a CDRH2 sequence of any one of SEQ ID NOs: 51-100, 920-1061, 1524-1703, and 2453-2524. In some instances, an antibody or antibody fragment described herein comprises a CDRH3 sequence of any one of SEQ ID NOs: 101-150, 1062-1202, 1704-1883, and 2525-2596. In some instances, an antibody or antibody fragment described herein comprises a sequence that is at least 80% identical to a CDRH3 sequence of any one of SEQ ID NOs: 101-150, 1062-1202, 1704-1883, and 2525-2596. In some instances, an antibody or antibody fragment described herein comprises a sequence that is at least 85% identical to a CDRH3 sequence of any one of SEQ ID NOs: 101-150, 1062-1202, 1704-1883, and 2525-2596. In some instances, an antibody or antibody fragment described herein comprises a sequence that is at least 90% identical to a CDRH3 sequence of any one of SEQ ID NOs: 101-150, 1062-1202, 1704-1883, and 2525-2596.

In some instances, an antibody or antibody fragment described herein comprises a sequence that is at least 95% identical to a CDRH3 sequence of any one of SEQ ID NOs: 101-150, 1062-1202, 1704-1883, and 2525-2596.

In some instances, an antibody or antibody fragment described herein comprises a CDRL1 sequence of any one of SEQ ID NOs: 196-210, 286-300, 412-438, and 634-662. In some instances, an antibody or antibody fragment described herein comprises a sequence that is at least 80% identical to a CDRL1 sequence of any one of SEQ ID NOs: 196-210, 286-300, 412-438, and 634-662. In some instances, an antibody or antibody fragment described herein comprises a sequence that is at least 85% identical to a CDRL1 sequence of any one of SEQ ID NOs: 196-210, 286-300, 412-438, and 634-662. In some instances, an antibody or antibody fragment described herein comprises a sequence that is at least 90% identical to a CDRL1 sequence of any one of SEQ ID NOs: 1196-210, 286-300, 412-438, and 634-662. In some instances, an antibody or antibody fragment described herein comprises a sequence that is at least 95% identical to a CDRL1 sequence of any one of SEQ ID NOs: 196-210, 286-300, 412-438, and 634-662. In some instances, an antibody or antibody fragment described herein comprises a CDRL2 sequence of any one of SEQ ID NOs: 211-225, 301-315, 439-465, and 663-691. In some instances, an antibody or antibody fragment described herein comprises a sequence that is at least 80% identical to a CDRL2 sequence of any one of SEQ ID NOs: 211-225, 301-315, 439-465, and 663-691. In some instances, an antibody or antibody fragment described herein comprises a sequence that is at least 85% identical to a CDRL2 sequence of any one of SEQ ID NOs: 211-225, 301-315, 439-465, and 663-691. In some instances, an antibody or antibody fragment described herein comprises a sequence that is at least 90% identical to a CDRL2 sequence of any one of SEQ ID NOs: 211-225, 301-315, 439-465, and 663-691. In some instances, an antibody or antibody fragment described herein comprises a sequence that is at least 95% identical to a CDRL2 sequence of any one of SEQ ID NOs: 211-225, 301-315, 439-465, and 663-691. In some instances, an antibody or antibody fragment described herein comprises a CDRL3 sequence of any one of SEQ ID NOs: 226-240, 316-330, 466-492, and 692-720. In some instances, an antibody or antibody fragment described herein comprises a sequence that is at least 80% identical to a CDRL3 sequence of any one of SEQ ID NOs: 226-240, 316-330, 466-492, and 692-720. In some instances, an antibody or antibody fragment described herein comprises a sequence that is at least 85% identical to a CDRL3 sequence of any one of SEQ ID NOs: 226-240, 316-330, 466-492, and 692-720. In some instances, an antibody or antibody fragment described herein comprises a sequence that is at least 90% identical to a CDRL3 sequence of any one of SEQ ID NOs: 226-240, 316-330, 466-492, and 692-720. In some instances, an antibody or antibody fragment described herein comprises a sequence that is at least 95% identical to a CDRL3 sequence of any one of SEQ ID NOs: 226-240, 316-330, 466-492, and 692-720.

In some embodiments, the antibody or antibody fragment comprising a variable domain, heavy chain region (VH) and a variable domain, light chain region (VL), wherein VH comprises complementarily determining regions CDRH1, CDRH2, and CDRH3, wherein VL comprises complementarily determining regions CDRL1, CDRL2, and CDRL3, and wherein (a) an amino acid sequence of CDRH1 is as set forth in any one of SEQ ID NOs: 151-165, 241-255, 331-357, and 547-575; (b) an amino acid sequence of CDRH2 is as set forth in any one of SEQ ID NOs: 166-180, 256-270, 358-384, and 576-604; (c) an amino acid sequence of CDRH3 is as set forth in any one of SEQ ID NOs: 181-195, 271-285, 385-411, and 605-633; (d) an amino acid sequence of CDRL1 is as set forth in any one of SEQ ID NOs: 196-210, 286-300, 412-438, and 634-662; (e) an amino acid sequence of CDRL2 is as set forth in any one of SEQ ID NOs: 211-225, 301-315, 439-465, and 663-691; and (f) an amino acid sequence of CDRL3 is as set forth in any one of SEQ ID NOs: 226-240, 316-330, 466-492, and 692-720. In some embodiments, the antibody or antibody fragment comprising a variable domain, heavy chain region (VH) and a variable domain, light chain region (VL), wherein VH comprises complementarity determining regions CDRH1, CDRH2, and CDRH3, wherein VL comprises complementarity determining regions CDRL1, CDRL2, and CDRL3, and wherein (a) an amino acid sequence of CDRH1 is at least or about 80%, 85%, 90%, or 95% identical to any one of SEQ ID NOs: 151-165, 241-255, 331-357, and 547-575; (b) an amino acid sequence of CDRH2 is at least or about 80%, 85%, 90%, or 95% identical to any one of SEQ ID NOs: 166-180, 256-270, 358-384, and 576-604; (c) an amino acid sequence of CDRH3 is at least or about 80%, 85%, 90%, or 95% identical to any one of SEQ ID NOs: 181-195, 271-285, 385-411, and 605-633; (d) an amino acid sequence of CDRL1 is at least or about 80%, 85%, 90%, or 95% identical to any one of SEQ ID NOs: 196-210, 286-300, 412-438, and 634-662; (e) an amino acid sequence of CDRL2 is at least or about 80%, 85%, 90%, or 95% identical to any one of SEQ ID NOs: 211-225, 301-315, 439-465, and 663-691; and (f) an amino acid sequence of CDRL3 is at least or about 80%, 85%, 90%, or 95% identical to any one of SEQ ID NOs: 226-240, 316-330, 466-492, and 692-720.

Described herein, in some embodiments, are antibodies or antibody fragments comprising a variable domain, heavy chain region (VH) and a variable domain, light chain region (VL), wherein the VH comprises an amino acid sequence at least about 90% identical to a sequence as set forth in any one of SEQ ID NOs: 493-519 and 721-749, and wherein the VL comprises an amino acid sequence at least about 90% identical to a sequence as set forth in any one of SEQ ID NOs: 520-546 and 750-778. In some instances, the antibodies or antibody fragments comprise VH comprising at least or about 70%, 80%, 85%, 90%, 91%, 92%, 93%, 94%, 95%, 96%, 97%, 98%, 99%, or 100% sequence identity to any one of SEQ ID NOs: 493-519 and 721-749, and VL comprising at least or about 70%, 80%, 85%, 90%, 91%, 92%, 93%, 94%, 95%, 96%, 97%, 98%, 99%, or 100% sequence identity to any one of SEQ ID NOs: 520-546 and 750-778.

Described herein, in some embodiments, are antibodies or antibody fragments comprising a variable domain, heavy chain region (VH), wherein the VH comprises an amino acid sequence at least about 90% identical to a sequence as set forth in any one of SEQ ID NOs: 1884-2063, 2302-2380, and 2597-2668. In some instances, the antibodies or antibody fragments comprise a heavy chain variable domain comprising at least or about 70%, 80%, 85%, 90%, 91%, 92%, 93%, 94%, 95%, 96%, 97%, 98%, 99%, or 100% sequence identity to any one of SEQ ID NOs: 1884-2063, 2302-2380, and 2597-2668.

The term "sequence identity" means that two polynucleotide sequences are identical (i.e., on a nucleotide-by-nucleotide basis) over the window of comparison. The term "percentage of sequence identity" is calculated by comparing two optimally aligned sequences over the window of comparison, determining the number of positions at which the identical nucleic acid base (e.g., A, T, C, G, U, or I) occurs in both sequences to yield the number of matched positions, dividing the number of matched positions by the total number of positions in the window of comparison (i.e., the window size), and multiplying the result by 100 to yield the percentage of sequence identity.

The term "homology" or "similarity" between two proteins is determined by comparing the amino acid sequence and its conserved amino acid substitutes of one protein sequence to the second protein sequence. Similarity may be determined by procedures which are well-known in the art, for example, a BLAST program (Basic Local Alignment Search Tool at the National Center for Biological Information).

The term "epitope" includes any determinant capable of being bound by an antigen binding protein, such as an antibody. An epitope is a region of an antigen that is bound by an antigen binding protein that targets that antigen, and when the antigen is a protein, includes specific amino acids that directly contact the antigen binding protein. Most often, epitopes reside on proteins, but in some instances can reside on other kinds of molecules, such as saccharides or lipids. Epitope determinants can include chemically active surface groupings of molecules such as amino acids, sugar side chains, phosphoryl or sulfonyl groups, and can have specific three dimensional structural characteristics, and/or specific charge characteristics. Generally, antibodies specific for a particular target antigen will preferentially recognize an epitope on the target antigen in a complex mixture of proteins and/or macromolecules.

Provided herein are libraries comprising nucleic acids encoding for SARS-CoV-2 antibodies. Antibodies described herein allow for improved stability for a range of SARS-CoV-2 or ACE2 binding domain encoding sequences. In some instances, the binding domain encoding sequences are determined by interactions between SARS-CoV-2 and ACE2.

Sequences of binding domains based on surface interactions between SARS-CoV-2 and ACE2 are analyzed using various methods. For example, multispecies computational analysis is performed. In some instances, a structure analysis is performed. In some instances, a sequence analysis is performed. Sequence analysis can be performed using a database known in the art. Non-limiting examples of databases include, but are not limited to, NCBI BLAST (blast.ncbi.nlm.nih.gov/Blast.cgi), UCSC Genome Browser (genome.ucsc.edu/), UniProt (www.uniprot.org/), and IUPHAR/BPS Guide to PHARMACOLOGY (guidetopharmacology.org/).

Described herein are SARS-CoV-2 or ACE2 binding domains designed based on sequence analysis among various organisms. For example, sequence analysis is performed to identify homologous sequences in different organisms. Exemplary organisms include, but are not limited to, mouse, rat, equine, sheep, cow, primate (e.g., chimpanzee, baboon, gorilla, orangutan, monkey), dog, cat, pig, donkey, rabbit, fish, fly, and human. In some instances, homologous sequences are identified in the same organism, across individuals.

Following identification of SARS-CoV-2 or ACE2 binding domains, libraries comprising nucleic acids encoding for the SARS-CoV-2 or ACE2 binding domains may be generated. In some instances, libraries of SARS-CoV-2 or ACE2 binding domains comprise sequences of SARS-CoV-2 or ACE2 binding domains designed based on conformational ligand interactions, peptide ligand interactions, small molecule ligand interactions, extracellular domains of SARS-CoV-2 or ACE2, or antibodies that target SARS-CoV-2 or ACE2. Libraries of SARS-CoV-2 or ACE2 binding domains may be translated to generate protein libraries. In some instances, libraries of SARS-CoV-2 or ACE2 binding domains are translated to generate peptide libraries, immunoglobulin libraries, derivatives thereof, or combinations thereof. In some instances, libraries of SARS-CoV-2 or ACE2 binding domains are translated to generate protein libraries that are further modified to generate peptidomimetic libraries. In some instances, libraries of SARS-CoV-2 or ACE2 binding domains are translated to generate protein libraries that are used to generate small molecules.

Methods described herein provide for synthesis of libraries of SARS-CoV-2 or ACE2 binding domains comprising nucleic acids each encoding for a predetermined variant of at least one predetermined reference nucleic acid sequence. In some cases, the predetermined reference sequence is a nucleic acid sequence encoding for a protein, and the variant library comprises sequences encoding for variation of at least a single codon such that a plurality of different variants of a single residue in the subsequent protein encoded by the synthesized nucleic acid are generated by standard translation processes. In some instances, the libraries of SARS-CoV-2 or ACE2 binding domains comprise varied nucleic acids collectively encoding variations at multiple positions. In some instances, the variant library comprises sequences encoding for variation of at least a single codon in a SARS-CoV-2 or ACE2 binding domain. In some instances, the variant library comprises sequences encoding for variation of multiple codons in a SARS-CoV-2 or ACE2 binding domain. An exemplary number of codons for variation include, but are not limited to, at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons.

Methods described herein provide for synthesis of libraries comprising nucleic acids encoding for the SARS-CoV-2 or ACE2 binding domains, wherein the libraries comprise sequences encoding for variation of length of the SARS-CoV-2 or ACE2 binding domains. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons less as compared to a predetermined reference sequence. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 200, 225, 250, 275, 300, or more than 300 codons more as compared to a predetermined reference sequence.

Following identification of SARS-CoV-2 or ACE2 binding domains, antibodies may be designed and synthesized to comprise the SARS-CoV-2 or ACE2 binding domains. Antibodies comprising SARS-CoV-2 or ACE2 binding domains may be designed based on binding, specificity, stability, expression, folding, or downstream activity. In some instances, the antibodies comprising SARS-CoV-2 or ACE2 binding domains enable contact with the SARS-CoV-2 or ACE2. In some instances, the antibodies comprising SARS-CoV-2 or ACE2 binding domains enables high affinity binding with the SARS-CoV-2 or ACE2. Exemplary amino acid sequences of SARS-CoV-2 or ACE2 binding domains comprise any one of SEQ ID NOs: 1-2668.

In some instances, the SARS-CoV-2 antibody comprises a binding affinity (e.g., $K_D$) to SARS-CoV-2 of less than 1 nM, less than 1.2 nM, less than 2 nM, less than 5 nM, less than 10 nM, less than 11 nm, less than 13.5 nM, less than 15 nM, less than 20 nM, less than 25 nM, or less than 30 nM. In some instances, the SARS-CoV-2 antibody comprises a $K_D$ of less than 1 nM. In some instances, the SARS-CoV-2 antibody comprises a $K_D$ of less than 1.2 nM. In some instances, the SARS-CoV-2 antibody comprises a $K_D$ of less than 2 nM. In some instances, the SARS-CoV-2 antibody comprises a $K_D$ of less than 5 nM. In some instances, the SARS-CoV-2 antibody comprises a $K_D$ of less than 10 nM. In some instances, the SARS-CoV-2 antibody comprises a $K_D$ of less than 13.5 nM. In some instances, the SARS-CoV-2 antibody comprises a $K_D$ of less than 15 nM. In some instances, the SARS-CoV-2 antibody comprises a $K_D$ of less than 20 nM. In some instances, the SARS-CoV-2 antibody comprises a $K_D$ of less than 25 nM. In some instances, the SARS-CoV-2 antibody comprises a $K_D$ of less than 30 nM.

In some instances, the ACE2 antibody comprises a binding affinity (e.g., $K_D$) to ACE2 of less than 1 nM, less than 1.2 nM, less than 2 nM, less than 5 nM, less than 10 nM, less than 11 nm, less than 13.5 nM, less than 15 nM, less than 20 nM, less than 25 nM, or less than 30 nM. In some instances, the ACE2 antibody comprises a $K_D$ of less than 1 nM. In some instances, the ACE2 antibody comprises a $K_D$ of less than 1.2 nM. In some instances, the ACE2 antibody comprises a $K_D$ of less than 2 nM. In some instances, the ACE2 antibody comprises a $K_D$ of less than 5 nM. In some instances, the ACE2 antibody comprises a $K_D$ of less than 10 nM. In some instances, the ACE2 antibody comprises a $K_D$ of less than 13.5 nM. In some instances, the ACE2 antibody comprises a $K_D$ of less than 15 nM. In some instances, the ACE2 antibody comprises a $K_D$ of less than 20 nM. In some instances, the ACE2 antibody comprises a $K_D$ of less than 25 nM. In some instances, the ACE2 antibody comprises a $K_D$ of less than 30 nM.

In some instances, the SARS-CoV-2 or ACE2 immunoglobulin is an agonist. In some instances, the SARS-CoV-2 or ACE2 immunoglobulin is an antagonist. In some instances, the SARS-CoV-2 or ACE2 immunoglobulin is an allosteric modulator. In some instances, the allosteric modulator is a negative allosteric modulator. In some instances, the allosteric modulator is a positive allosteric modulator. In some instances, the SARS-CoV-2 or ACE2 immunoglobulin results in agonistic, antagonistic, or allosteric effects at a concentration of at least or about 1 nM, 2 nM, 4 nM, 6 nM, 8 nM, 10 nM, 20 nM, 30 nM, 40 nM, 50 nM, 60 nM, 70 nM, 80 nM, 90 nM, 100 nM, 120 nM, 140 nM, 160 nM, 180 nM, 200 nM, 300 nM, 400 nM, 500 nM, 600 nM, 700 nM, 800 nM, 900 nM, 1000 nM, or more than 1000 nM. In some instances, the SARS-CoV-2 or ACE2 immunoglobulin is a negative allosteric modulator. In some instances, the SARS-CoV-2 or ACE2 immunoglobulin is a negative allosteric modulator at a concentration of at least or about 0.001, 0.005, 0.01, 0.05, 0.1, 0.5, 1 nM, 2 nM, 4 nM, 6 nM, 8 nM, 10 nM, 20 nM, 30 nM, 40 nM, 50 nM, 60 nM, 70 nM, 80 nM, 90 nM, 100 nM, or more than 100 nM. In some instances, the SARS-CoV-2 or ACE2 immunoglobulin is a negative allosteric modulator at a concentration in a range of about 0.001 to about 100, 0.01 to about 90, about 0.1 to about 80, 1 to about 50, about 10 to about 40 nM, or about 1 to about 10 nM. In some instances, the SARS-CoV-2 or ACE2 immunoglobulin comprises an EC50 or IC50 of at least or about 0.001, 0.0025, 0.005, 0.01, 0.025, 0.05, 0.06, 0.07, 0.08, 0.9, 0.1, 0.5, 1, 2, 3, 4, 5, 6, or more than 6 nM. In some instances, the SARS-CoV-2 or ACE2 immunoglobulin comprises an EC50 or IC50 of at least or about 1 nM, 2 nM, 4 nM, 6 nM, 8 nM, 10 nM, 20 nM, 30 nM, 40 nM, 50 nM, 60 nM, 70 nM, 80 nM, 90 nM, 100 nM, or more than 100 nM.

In some instances, the affinity of the SARS-CoV-2 or ACE2 antibody generated by methods as described herein is at least or about 1.5×, 2.0×, 5×, 10×, 20×, 30×, 40×, 50×, 60×, 70×, 80×, 90×, 100×, 200×, or more than 200× improved binding affinity as compared to a comparator antibody. In some instances, the SARS-CoV-2 or ACE2 antibody generated by methods as described herein is at least or about 1.5×, 2.0×, 5×, 10×, 20×, 30×, 40×, 50×, 60×, 70×, 80×, 90×, 100×, 200×, or more than 200× improved function as compared to a comparator antibody. In some instances, the comparator antibody is an antibody with similar structure, sequence, or antigen target.

Provided herein are SARS-CoV-2 or ACE2 binding libraries comprising nucleic acids encoding for antibodies comprising SARS-CoV-2 or ACE2 binding domains comprise variation in domain type, domain length, or residue variation. In some instances, the domain is a region in the antibody comprising the SARS-CoV-2 or ACE2 binding domains. For example, the region is the VH, CDRH3, or VL domain. In some instances, the domain is the SARS-CoV-2 or ACE2 binding domain.

Methods described herein provide for synthesis of a SARS-CoV-2 or ACE21 binding library of nucleic acids each encoding for a predetermined variant of at least one predetermined reference nucleic acid sequence. In some cases, the predetermined reference sequence is a nucleic acid sequence encoding for a protein, and the variant library comprises sequences encoding for variation of at least a single codon such that a plurality of different variants of a single residue in the subsequent protein encoded by the synthesized nucleic acid are generated by standard translation processes. In some instances, the SARS-CoV-2 or ACE2 binding library comprises varied nucleic acids collectively encoding variations at multiple positions. In some instances, the variant library comprises sequences encoding for variation of at least a single codon of a VH or VL domain. In some instances, the variant library comprises sequences encoding for variation of at least a single codon in a SARS-CoV-2 or ACE2 binding domain. For example, at least one single codon of a SARS-CoV-2 or ACE2 binding domain is varied. In some instances, the variant library comprises sequences encoding for variation of multiple codons of a VH or VL domain. In some instances, the variant library comprises sequences encoding for variation of multiple codons in a SARS-CoV-2 or ACE2 binding domain. An exemplary number of codons for variation include, but are not limited to, at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons.

Methods described herein provide for synthesis of a SARS-CoV-2 or ACE2 binding library of nucleic acids each encoding for a predetermined variant of at least one predetermined reference nucleic acid sequence, wherein the SARS-CoV-2 or ACE2 binding library comprises sequences encoding for variation of length of a domain. In some instances, the domain is VH or VL domain. In some instances, the domain is the SARS-CoV-2 or ACE2 binding domain. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons less as compared to a predetermined reference sequence. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 200, 225, 250, 275, 300, or more than 300 codons more as compared to a predetermined reference sequence.

Provided herein are SARS-CoV-2 or ACE2 binding libraries comprising nucleic acids encoding for antibodies comprising SARS-CoV-2 or ACE2 binding domains, wherein the SARS-CoV-2 or ACE2 binding libraries are synthesized with various numbers of fragments. In some instances, the fragments comprise the VH or VL domain. In some instances, the SARS-CoV-2 or ACE2 binding libraries are synthesized with at least or about 2 fragments, 3 fragments, 4 fragments, 5 fragments, or more than 5 fragments. The length of each of the nucleic acid fragments or average length of the nucleic acids synthesized may be at least or about 50, 75, 100, 125, 150, 175, 200, 225, 250, 275, 300, 325, 350, 375, 400, 425, 450, 475, 500, 525, 550, 575, 600, or more than 600 base pairs. In some instances, the length is about 50 to 600, 75 to 575, 100 to 550, 125 to 525, 150 to 500, 175 to 475, 200 to 450, 225 to 425, 250 to 400, 275 to 375, or 300 to 350 base pairs.

SARS-CoV-2 or ACE2 binding libraries comprising nucleic acids encoding for antibodies comprising SARS-CoV-2 or ACE2 binding domains as described herein comprise various lengths of amino acids when translated. In some instances, the length of each of the amino acid fragments or average length of the amino acid synthesized may be at least or about 15, 20, 25, 30, 35, 40, 45, 50, 55, 60, 65, 70, 75, 80, 85, 90, 95, 100, 105, 110, 115, 120, 125, 130, 135, 140, 145, 150, or more than 150 amino acids. In some instances, the length of the amino acid is about 15 to 150, 20 to 145, 25 to 140, 30 to 135, 35 to 130, 40 to 125, 45 to 120, 50 to 115, 55 to 110, 60 to 110, 65 to 105, 70 to 100, or 75 to 95 amino acids. In some instances, the length of the amino acid is about 22 to about 75 amino acids.

SARS-CoV-2 or ACE2 binding libraries comprising de novo synthesized variant sequences encoding for antibodies comprising SARS-CoV-2 or ACE2 binding domains comprise a number of variant sequences. In some instances, a number of variant sequences is de novo synthesized for a CDRH1, CDRH2, CDRH3, CDRL1, CDRL2, CDRL3, VL, VH, or a combination thereof. In some instances, a number of variant sequences is de novo synthesized for framework element 1 (FW1), framework element 2 (FW2), framework element 3 (FW3), or framework element 4 (FW4). In some instances, a number of variant sequences are de novo synthesized for a SARS-CoV-2 or ACE2 binding domain. The number of variant sequences may be at least or about 5, 10, 15, 20, 25, 30, 35, 40, 45, 50, 55, 60, 65, 70, 75, 80, 85, 90, 95, 100, 125, 150, 175, 200, 225, 250, 275, 300, 325, 350, 375, 400, 425, 450, 475, 500, or more than 500 sequences. In some instances, the number of variant sequences is about 10 to 300, 25 to 275, 50 to 250, 75 to 225, 100 to 200, or 125 to 150 sequences.

SARS-CoV-2 or ACE2 binding libraries comprising de novo synthesized variant sequences encoding for antibodies comprising SARS-CoV-2 or ACE2 binding domains comprise improved diversity. In some instances, variants include affinity maturation variants. Alternatively or in combination, variants include variants in other regions of the antibody including, but not limited to, CDRH1, CDRH2, CDRL1, CDRL2, and CDRL3. In some instances, the number of variants of the SARS-CoV-2 or ACE2 binding libraries is least or about $10^4$, $10^5$, $10^6$, $10^7$, $10^8$, $10^9$, $10^{10}$, $10^{11}$, $10^{12}$, $10^{13}$, $10^{14}$ or more than $10^{14}$ non-identical sequences.

Following synthesis of SARS-CoV-2 or ACE2 binding libraries comprising nucleic acids encoding antibodies comprising SARS-CoV-2 or ACE2 binding domains, libraries may be used for screening and analysis. For example, libraries are assayed for library displayability and panning. In some instances, displayability is assayed using a selectable tag. Exemplary tags include, but are not limited to, a radioactive label, a fluorescent label, an enzyme, a chemiluminescent tag, a colorimetric tag, an affinity tag or other labels or tags that are known in the art. In some instances, the tag is histidine, polyhistidine, myc, hemagglutinin (HA), or FLAG. For example, SARS-CoV-2 or ACE2 binding libraries comprise nucleic acids encoding antibodies comprising SARS-CoV-2 or ACE2 binding domains with multiple tags such as GFP, FLAG, and Lucy as well as a DNA barcode. In some instances, libraries are assayed by sequencing using various methods including, but not limited to, single-molecule real-time (SMRT) sequencing, Polony sequencing, sequencing by ligation, reversible terminator sequencing, proton detection sequencing, ion semiconductor sequencing, nanopore sequencing, electronic sequencing, pyrosequencing, Maxam-Gilbert sequencing, chain termination (e.g., Sanger) sequencing, +S sequencing, or sequencing by synthesis.

As used herein, the term antibody will be understood to include proteins having the characteristic two-armed, Y-shape of a typical antibody molecule as well as one or more fragments of an antibody that retain the ability to specifically bind to an antigen. Exemplary antibodies include, but are not limited to, a monoclonal antibody, a polyclonal antibody, a bispecific antibody, a multispecific antibody, a grafted antibody, a human antibody, a humanized antibody, a synthetic antibody, a chimeric antibody, a camelized antibody, a single-chain Fvs (scFv) (including fragments in which the VL and VH are joined using recombinant methods by a synthetic or natural linker that enables them to be made as a single protein chain in which the VL and VH regions pair to form monovalent molecules, including single chain Fab and scFab), a single chain antibody, a Fab fragment (including monovalent fragments comprising the VL, VH, CL, and CH1 domains), a F(ab')2 fragment (including bivalent fragments comprising two Fab fragments linked by a disulfide bridge at the hinge region), a Fd fragment (including fragments comprising the VH and CH1 fragment), a Fv fragment (including fragments comprising the VL and VH domains of a single arm of an antibody), a single-domain antibody (dAb or sdAb) (including fragments comprising a VH domain), an isolated complementarity determining region (CDR), a diabody (including fragments comprising bivalent dimers such as two VL and VH domains bound to each other and recognizing two different antigens), a fragment comprised of only a single monomeric variable domain, disulfide-linked Fvs (sdFv), an intrabody, an anti-idiotypic (anti-Id) antibody, or ab antigen-binding fragments thereof. In some instances, the libraries disclosed herein comprise nucleic acids encoding for an antibody, wherein the antibody is a Fv antibody, including Fv antibodies comprised of the minimum antibody fragment which contains a complete antigen-recognition and antigen-binding site. In some embodiments, the Fv antibody consists of a dimer of one heavy chain and one light chain variable domain in tight, non-covalent association, and the three hypervariable regions of each variable domain interact to define an antigen-binding site on the surface of the VH-VL dimer. In some embodiments, the six hypervariable regions confer antigen-binding specificity to the antibody. In some embodiments, a single variable domain (or half of an Fv comprising only three hypervariable regions specific for an antigen, including single domain antibodies isolated from camelid animals comprising one heavy chain variable domain such as VHH antibodies or nanobodies) has the ability to recognize and bind antigen. In some instances, the libraries disclosed herein comprise nucleic acids encoding for an antibody, wherein the antibody is a single-chain Fv or scFv, including antibody fragments comprising a VH, a VL, or both a VH and VL domain, wherein both domains are present in a single polypeptide chain. In some embodiments, the Fv polypeptide further comprises a polypeptide linker between the VH and VL domains allowing the scFv to form the desired structure for antigen binding. In some instances, a scFv is linked to the Fc fragment or a VHH is linked to the Fc fragment (including minibodies). In some instances, the antibody comprises immunoglobulin molecules and immunologically active fragments of immunoglobulin molecules, e.g., molecules that contain an antigen binding site. Immunoglobulin molecules are of any type (e.g., IgG, IgE, IgM, IgD, IgA and IgY), class (e.g., IgG 1, IgG 2, IgG 3, IgG 4, IgA 1 and IgA 2) or subclass.

In some embodiments, the antibody is a multivalent antibody. In some embodiments, the antibody is a monovalent, bivalent, or multivalent antibody. In some instances, the antibody is monospecific, bispecific, or multispecific. In some embodiments, the antibody is monovalent monospecific, monovalent bispecific, monovalent multispecific, bivalent monospecific, bivalent bispecific, bivalent multispecific, multivalent monospecific, multivalent bispecific, multivalent multispecific. In some instances, the antibody is homodimeric, heterodimeric, or heterotrimeric.

In some embodiments, libraries comprise immunoglobulins that are adapted to the species of an intended therapeutic target. Generally, these methods include "mammalization" and comprises methods for transferring donor antigen-binding information to a less immunogenic mammal antibody acceptor to generate useful therapeutic treatments. In some instances, the mammal is mouse, rat, equine, sheep, cow, primate (e.g., chimpanzee, baboon, gorilla, orangutan, monkey), dog, cat, pig, donkey, rabbit, and human. In some instances, provided herein are libraries and methods for felinization and caninization of antibodies.

"Humanized" forms of non-human antibodies can be chimeric antibodies that contain minimal sequence derived from the non-human antibody. A humanized antibody is generally a human antibody (recipient antibody) in which residues from one or more CDRs are replaced by residues from one or more CDRs of a non-human antibody (donor antibody). The donor antibody can be any suitable non-human antibody, such as a mouse, rat, rabbit, chicken, or non-human primate antibody having a desired specificity, affinity, or biological effect. In some instances, selected framework region residues of the recipient antibody are replaced by the corresponding framework region residues from the donor antibody. Humanized antibodies may also comprise residues that are not found in either the recipient antibody or the donor antibody. In some instances, these modifications are made to further refine antibody performance.

"Caninization" can comprise a method for transferring non-canine antigen-binding information from a donor antibody to a less immunogenic canine antibody acceptor to generate treatments useful as therapeutics in dogs. In some instances, caninized forms of non-canine antibodies provided herein are chimeric antibodies that contain minimal sequence derived from non-canine antibodies. In some instances, caninized antibodies are canine antibody sequences ("acceptor" or "recipient" antibody) in which hypervariable region residues of the recipient are replaced by hypervariable region residues from a non-canine species ("donor" antibody) such as mouse, rat, rabbit, cat, dogs, goat, chicken, bovine, horse, llama, camel, dromedaries, sharks, non-human primates, human, humanized, recombinant sequence, or an engineered sequence having the desired properties. In some instances, framework region (FR) residues of the canine antibody are replaced by corresponding non-canine FR residues. In some instances, caninized antibodies include residues that are not found in the recipient antibody or in the donor antibody. In some instances, these modifications are made to further refine antibody performance. The caninized antibody may also comprise at least a portion of an immunoglobulin constant region (Fc) of a canine antibody.

"Felinization" can comprise a method for transferring non-feline antigen-binding information from a donor antibody to a less immunogenic feline antibody acceptor to generate treatments useful as therapeutics in cats. In some instances, felinized forms of non-feline antibodies provided herein are chimeric antibodies that contain minimal sequence derived from non-feline antibodies. In some instances, felinized antibodies are feline antibody sequences ("acceptor" or "recipient" antibody) in which hypervariable region residues of the recipient are replaced by hypervariable region residues from a non-feline species ("donor" antibody) such as mouse, rat, rabbit, cat, dogs, goat, chicken, bovine, horse, llama, camel, dromedaries, sharks, non-human primates, human, humanized, recombinant sequence, or an engineered sequence having the desired properties. In some instances, framework region (FR) residues of the feline antibody are replaced by corresponding non-feline FR residues. In some instances, felinized antibodies include residues that are not found in the recipient antibody or in the donor antibody. In some instances, these modifications are made to further refine antibody performance. The felinized antibody may also comprise at least a portion of an immunoglobulin constant region (Fc) of a felinize antibody.

Methods as described herein may be used for optimization of libraries encoding a non-immunoglobulin. In some instances, the libraries comprise antibody mimetics. Exemplary antibody mimetics include, but are not limited to, anticalins, affilins, affibody molecules, affimers, affitins, alphabodies, avimers, atrimers, DARPins, fynomers, Kunitz domain-based proteins, monobodies, anticalins, knottins, armadillo repeat protein-based proteins, and bicyclic peptides.

Libraries described herein comprising nucleic acids encoding for an antibody comprise variations in at least one region of the antibody. Exemplary regions of the antibody for variation include, but are not limited to, a complementarity-determining region (CDR), a variable domain, or a constant domain. In some instances, the CDR is CDR1, CDR2, or CDR3. In some instances, the CDR is a heavy domain including, but not limited to, CDRH1, CDRH2, and CDRH3. In some instances, the CDR is a light domain including, but not limited to, CDRL1, CDRL2, and CDRL3. In some instances, the variable domain is variable domain, light chain (VL) or variable domain, heavy chain (VH). In some instances, the VL domain comprises kappa or lambda chains. In some instances, the constant domain is constant domain, light chain (CL) or constant domain, heavy chain (CH).

Methods described herein provide for synthesis of libraries comprising nucleic acids encoding an antibody, wherein each nucleic acid encodes for a predetermined variant of at least one predetermined reference nucleic acid sequence. In some cases, the predetermined reference sequence is a nucleic acid sequence encoding for a protein, and the variant library comprises sequences encoding for variation of at least a single codon such that a plurality of different variants of a single residue in the subsequent protein encoded by the synthesized nucleic acid are generated by standard translation processes. In some instances, the antibody library comprises varied nucleic acids collectively encoding variations at multiple positions. In some instances, the variant library comprises sequences encoding for variation of at least a single codon of a CDRH1, CDRH2, CDRH3, CDRL1, CDRL2, CDRL3, VL, or VH domain. In some instances, the variant library comprises sequences encoding for variation of multiple codons of a CDRH1, CDRH2, CDRH3, CDRL1, CDRL2, CDRL3, VL, or VH domain. In some instances, the variant library comprises sequences encoding for variation of multiple codons of framework element 1 (FW1), framework element 2 (FW2), framework element 3 (FW3), or framework element 4 (FW4). An exemplary number of codons for variation include, but are not limited to, at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons.

In some instances, the at least one region of the antibody for variation is from heavy chain V-gene family, heavy chain D-gene family, heavy chain J-gene family, light chain V-gene family, or light chain J-gene family. In some instances, the light chain V-gene family comprises immunoglobulin kappa (IGK) gene or immunoglobulin lambda (IGL). Exemplary regions of the antibody for variation include, but are not limited to, IGHV1-18, IGHV1-69, IGHV1-8, IGHV3-21, IGHV3-23, IGHV3-30/33m, IGHV3-28, IGHV1-69, IGHV3-74, IGHV4-39, IGHV4-59/61, IGKV1-39, IGKV1-9, IGKV2-28, IGKV3-11, IGKV3-15, IGKV3-20, IGKV4-1, IGLV1-51, IGLV2-14, IGLV1-40, and IGLV3-1. In some instances, the gene is IGHV1-69, IGHV3-30, IGHV3-23, IGHV3, IGHV1-46, IGHV3-7, IGHV1, or IGHV1-8. In some instances, the gene is IGHV1-69 and IGHV3-30. In some instances, the region of the antibody for variation is IGHJ3, IGHJ6, IGHJ, IGHJ4, IGHJ5, IGHJ2, or IGH1. In some instances, the region of the antibody for variation is IGHJ3, IGHJ6, IGHJ, or IGHJ4. In some instances, the at least one region of the antibody for variation is IGHV1-69, IGHV3-23, IGKV3-20, IGKV1-39, or combinations thereof. In some instances, the at least one region of the antibody for variation is IGHV1-69 and IGKV3-20, In some instances, the at least one region of the antibody for variation is IGHV1-69 and IGKV1-39. In some instances, the at least one region of the antibody for variation is IGHV3-23 and IGKV3-20. In some instances, the at least one region of the antibody for variation is IGHV3-23 and IGKV1-39.

Provided herein are libraries comprising nucleic acids encoding for antibodies, wherein the libraries are synthesized with various numbers of fragments. In some instances, the fragments comprise the CDRH1, CDRH2, CDRH3, CDRL1, CDRL2, CDRL3, VL, or VH domain. In some instances, the fragments comprise framework element 1 (FW1), framework element 2 (FW2), framework element 3 (FW3), or framework element 4 (FW4). In some instances, the antibody libraries are synthesized with at least or about 2 fragments, 3 fragments, 4 fragments, 5 fragments, or more than 5 fragments. The length of each of the nucleic acid fragments or average length of the nucleic acids synthesized may be at least or about 50, 75, 100, 125, 150, 175, 200, 225, 250, 275, 300, 325, 350, 375, 400, 425, 450, 475, 500, 525, 550, 575, 600, or more than 600 base pairs. In some instances, the length is about 50 to 600, 75 to 575, 100 to 550, 125 to 525, 150 to 500, 175 to 475, 200 to 450, 225 to 425, 250 to 400, 275 to 375, or 300 to 350 base pairs.

Libraries comprising nucleic acids encoding for antibodies as described herein comprise various lengths of amino acids when translated. In some instances, the length of each of the amino acid fragments or average length of the amino acid synthesized may be at least or about 15, 20, 25, 30, 35, 40, 45, 50, 55, 60, 65, 70, 75, 80, 85, 90, 95, 100, 105, 110, 115, 120, 125, 130, 135, 140, 145, 150, or more than 150 amino acids. In some instances, the length of the amino acid is about 15 to 150, 20 to 145, 25 to 140, 30 to 135, 35 to 130, 40 to 125, 45 to 120, 50 to 115, 55 to 110, 60 to 110, 65 to 105, 70 to 100, or 75 to 95 amino acids. In some instances, the length of the amino acid is about 22 amino acids to about 75 amino acids. In some instances, the antibodies comprise at least or about 100, 200, 300, 400, 500, 600, 700, 800, 900, 1000, 2000, 3000, 4000, 5000, or more than 5000 amino acids.

A number of variant sequences for the at least one region of the antibody for variation are de novo synthesized using methods as described herein. In some instances, a number of variant sequences is de novo synthesized for CDRH1, CDRH2, CDRH3, CDRL1, CDRL2, CDRL3, VL, VH, or combinations thereof. In some instances, a number of variant sequences is de novo synthesized for framework element 1 (FW1), framework element 2 (FW2), framework element 3 (FW3), or framework element 4 (FW4). The number of variant sequences may be at least or about 5, 10, 15, 20, 25, 30, 35, 40, 45, 50, 55, 60, 65, 70, 75, 80, 85, 90, 95, 100, 125, 150, 175, 200, 225, 250, 275, 300, 325, 350, 375, 400, 425, 450, 475, 500, or more than 500 sequences. In some instances, the number of variant sequences is at least or about 500, 600, 700, 800, 900, 1000, 2000, 3000, 4000, 5000, 6000, 7000, 8000, or more than 8000 sequences. In some instances, the number of variant sequences is about 10 to 500, 25 to 475, 50 to 450, 75 to 425, 100 to 400, 125 to 375, 150 to 350, 175 to 325, 200 to 300, 225 to 375, 250 to 350, or 275 to 325 sequences.

Variant sequences for the at least one region of the antibody, in some instances, vary in length or sequence. In some instances, the at least one region that is de novo synthesized is for CDRH1, CDRH2, CDRH3, CDRL1, CDRL2, CDRL3, VL, VH, or combinations thereof. In some instances, the at least one region that is de novo synthesized is for framework element 1 (FW1), framework element 2 (FW2), framework element 3 (FW3), or framework element 4 (FW4). In some instances, the variant sequence comprises at least or about 1, 2, 3, 4, 5, 6, 7, 8, 9, 10, 15, 20, 25, 30, 35, 40, 45, 50, or more than 50 variant nucleotides or amino acids as compared to wild-type. In some instances, the variant sequence comprises at least or about 1, 2, 3, 4, 5, 6, 7, 8, 9, 10, 15, 20, 25, 30, 35, 40, 45, or 50 additional nucleotides or amino acids as compared to wild-type. In some instances, the variant sequence comprises at least or about 1, 2, 3, 4, 5, 6, 7, 8, 9, 10, 15, 20, 25, 30, 35, 40, 45, or 50 less nucleotides or amino acids as compared to wild-type. In some instances, the libraries comprise at least or about $10^1$, $10^2$, $10^3$, $10^4$, $10^5$, $10^6$, $10^7$, $10^8$, $10^9$, $10^{10}$, or more than $10^{10}$ variants.

Following synthesis of antibody libraries, antibody libraries may be used for screening and analysis. For example, antibody libraries are assayed for library displayability and panning. In some instances, displayability is assayed using a selectable tag. Exemplary tags include, but are not limited to, a radioactive label, a fluorescent label, an enzyme, a chemiluminescent tag, a colorimetric tag, an affinity tag or other labels or tags that are known in the art. In some instances, the tag is histidine, polyhistidine, myc, hemagglutinin (HA), or FLAG. In some instances, antibody libraries are assayed by sequencing using various methods including, but not limited to, single-molecule real-time (SMRT) sequencing, Polony sequencing, sequencing by ligation, reversible terminator sequencing, proton detection sequencing, ion semiconductor sequencing, nanopore sequencing, electronic sequencing, pyrosequencing, Maxam-Gilbert sequencing, chain termination (e.g., Sanger) sequencing, +S sequencing, or sequencing by synthesis. In some instances, antibody libraries are displayed on the surface of a cell or phage. In some instances, antibody libraries are enriched for sequences with a desired activity using phage display.

In some instances, the antibody libraries are assayed for functional activity, structural stability (e.g., thermal stable or pH stable), expression, specificity, or a combination thereof. In some instances, the antibody libraries are assayed for antibody capable of folding. In some instances, a region of the antibody is assayed for functional activity, structural stability, expression, specificity, folding, or a combination thereof. For example, a VH region or VL region is assayed for functional activity, structural stability, expression, specificity, folding, or a combination thereof.

In some instances, the affinity of antibodies or IgGs generated by methods as described herein is at least or about 1.5×, 2.0×, 5×, 10×, 20×, 30×, 40×, 50×, 60×, 70×, 80×, 90×, 100×, 200×, or more than 200× improved binding affinity as compared to a comparator antibody. In some instances, the affinity of antibodies or IgGs generated by methods as described herein is at least or about 1.5×, 2.0×, 5×, 10×, 20×, 30×, 40×, 50×, 60×, 70×, 80×, 90×, 100×, 200×, or more than 200× improved function as compared to a comparator antibody. In some instances, the comparator antibody is an antibody with similar structure, sequence, or antigen target.

Expression Systems

Provided herein are libraries comprising nucleic acids encoding for antibody comprising binding domains, wherein the libraries have improved specificity, stability, expression, folding, or downstream activity. In some instances, libraries described herein are used for screening and analysis.

Provided herein are libraries comprising nucleic acids encoding for antibody comprising binding domains, wherein the nucleic acid libraries are used for screening and analysis. In some instances, screening and analysis comprises in vitro, in vivo, or ex vivo assays. Cells for screening include primary cells taken from living subjects or cell lines. Cells may be from prokaryotes (e.g., bacteria and fungi) or eukaryotes (e.g., animals and plants). Exemplary animal cells include, without limitation, those from a mouse, rabbit, primate, and insect. In some instances, cells for screening include a cell line including, but not limited to, Chinese Hamster Ovary (CHO) cell line, human embryonic kidney (HEK) cell line, or baby hamster kidney (BHK) cell line. In some instances, nucleic acid libraries described herein may also be delivered to a multicellular organism. Exemplary multicellular organisms include, without limitation, a plant, a mouse, rabbit, primate, and insect.

Nucleic acid libraries described herein may be screened for various pharmacological or pharmacokinetic properties. In some instances, the libraries are screened using in vitro assays, in vivo assays, or ex vivo assays. For example, in vitro pharmacological or pharmacokinetic properties that are screened include, but are not limited to, binding affinity, binding specificity, and binding avidity. Exemplary in vivo pharmacological or pharmacokinetic properties of libraries described herein that are screened include, but are not limited to, therapeutic efficacy, activity, preclinical toxicity properties, clinical efficacy properties, clinical toxicity properties, immunogenicity, potency, and clinical safety properties.

Provided herein are nucleic acid libraries, wherein the nucleic acid libraries may be expressed in a vector. Expression vectors for inserting nucleic acid libraries disclosed herein may comprise eukaryotic or prokaryotic expression vectors. Exemplary expression vectors include, without limitation, mammalian expression vectors: pSF-CMV-NEO-NH2-PPT-3×FLAG, pSF-CMV-NEO-COOH-3×FLAG, pSF-CMV-PURO-NH2-GST-TEV, pSF-OXB20-COOH-TEV-FLAG®-6His ("6His" disclosed as SEQ ID NO: 2672), pCEP4 pDEST27, pSF-CMV-Ub-KrYFP, pSF-CMV-FMDV-daGFP, pEF1a-mCherry-N1 Vector, pEF1a-tdTomato Vector, pSF-CMV-FMDV-Hygro, pSF-CMV-PGK-Puro, pMCP-tag(m), and pSF-CMV-PURO-NH2-CMYC; bacterial expression vectors: pSF-OXB20-BetaGal, pSF-OXB20-Fluc, pSF-OXB20, and pSF-Tac; plant expression vectors: pRI 101-AN DNA and pCambia2301; and yeast expression vectors: pTYB21 and pKLAC2, and insect vectors: pAc5.1/V5-His A and pDEST8. In some instances, the vector is pcDNA3 or pcDNA3.1.

Described herein are nucleic acid libraries that are expressed in a vector to generate a construct comprising an antibody. In some instances, a size of the construct varies. In some instances, the construct comprises at least or about 500, 600, 700, 800, 900, 1000, 1100, 1300, 1400, 1500, 1600, 1700, 1800, 2000, 2400, 2600, 2800, 3000, 3200, 3400, 3600, 3800, 4000, 4200, 4400, 4600, 4800, 5000, 6000, 7000, 8000, 9000, 10000, or more than 10000 bases. In some instances, a the construct comprises a range of about 300 to 1,000, 300 to 2,000, 300 to 3,000, 300 to 4,000, 300 to 5,000, 300 to 6,000, 300 to 7,000, 300 to 8,000, 300 to 9,000, 300 to 10,000, 1,000 to 2,000, 1,000 to 3,000, 1,000 to 4,000, 1,000 to 5,000, 1,000 to 6,000, 1,000 to 7,000, 1,000 to 8,000, 1,000 to 9,000, 1,000 to 10,000, 2,000 to 3,000, 2,000 to 4,000, 2,000 to 5,000, 2,000 to 6,000, 2,000 to 7,000, 2,000 to 8,000, 2,000 to 9,000, 2,000 to 10,000, 3,000 to 4,000, 3,000 to 5,000, 3,000 to 6,000, 3,000 to 7,000, 3,000 to 8,000, 3,000 to 9,000, 3,000 to 10,000, 4,000 to 5,000, 4,000 to 6,000, 4,000 to 7,000, 4,000 to 8,000, 4,000 to 9,000, 4,000 to 10,000, 5,000 to 6,000, 5,000 to 7,000, 5,000 to 8,000, 5,000 to 9,000, 5,000 to 10,000, 6,000 to 7,000, 6,000 to 8,000, 6,000 to 9,000, 6,000 to 10,000, 7,000 to 8,000, 7,000 to 9,000, 7,000 to 10,000, 8,000 to 9,000, 8,000 to 10,000, or 9,000 to 10,000 bases.

Provided herein are libraries comprising nucleic acids encoding for antibodies, wherein the nucleic acid libraries are expressed in a cell. In some instances, the libraries are synthesized to express a reporter gene. Exemplary reporter genes include, but are not limited to, acetohydroxyacid synthase (AHAS), alkaline phosphatase (AP), beta galactosidase (LacZ), beta glucuronidase (GUS), chloramphenicol acetyltransferase (CAT), green fluorescent protein (GFP), red fluorescent protein (RFP), yellow fluorescent protein (YFP), cyan fluorescent protein (CFP), cerulean fluorescent protein, citrine fluorescent protein, orange fluorescent protein, cherry fluorescent protein, turquoise fluorescent protein, blue fluorescent protein, horseradish peroxidase (HRP), luciferase (Luc), nopaline synthase (NOS), octopine synthase (OCS), luciferase, and derivatives thereof. Methods to determine modulation of a reporter gene are well known in the art, and include, but are not limited to, fluorometric methods (e.g. fluorescence spectroscopy, Fluorescence Activated Cell Sorting (FACS), fluorescence microscopy), and antibiotic resistance determination.

Epitopes Bound by Therapeutically Useful SARS-CoV-2 or ACE2 Antibodies

Described herein is a unique epitope of SARS-CoV-2 or ACE2. The epitope described herein consists of stretches of amino acids that are present in the SARS-CoV-2 S protein receptor binding domain (RBD). In some embodiments, this binding comprises weak (Van der Waals attraction), medium (hydrogen binding), strong (salt bridge) interactions, or combinations thereof. In certain embodiments, a contact residue is a residue on SARS-CoV-2 that forms a hydrogen bond with a residue on an anti-SARS-CoV-2 antibody. In certain embodiments, a contact residue is a residue on SARS-CoV-2 that forms a salt bridge with a residue on an anti-SARS-CoV-2 antibody. In certain embodiments, a contact residue is a residue on SARS-CoV-2 that results in a Van der Waals attraction with and is within at least 5, 4, or 3 angstroms of a residue on an anti-SARS-CoV-2 antibody.

In certain embodiments, described herein is an isolated antibody that binds any one, two, three, four, five, six, seven, eight, nine, ten, eleven, twelve, thirteen, fourteen, fifteen, sixteen, seventeen, eighteen, nineteen, or twenty of the following residues: R102, N125, F157, S172, F175, L176, R190, Y265, I326, R328, K378, V382, S383, P384, K417, T430, N450, L452, F456, I468, I472, G476, F486, N487, Y489, F490, T531, N532, L533, F543, L552, S555, F559, or F562 of SARS-CoV-2 S protein RBD. In certain embodiments, described herein is an isolated antibody that binds all of the following residues: R102, N125, F157, S172, F175, L176, R190, Y265, I326, R328, K378, V382, S383, P384, K417, T430, N450, L452, F456, I468, I472, G476, F486, N487, Y489, F490, T531, N532, L533, F543, L552, S555, F559, or F562 of SARS-CoV-2 S protein RBD. In certain embodiments, described herein is an isolated antibody that binds all of the following residues: V382, S383, P384, or T430 of SARS-CoV-2 S protein RBD. In certain embodiments, described herein is an isolated antibody that binds all of the following residues K378 or P384 of SARS-CoV-2 S protein RBD. In certain embodiments, described herein is an isolated antibody that binds all of the following residues: R102, N125, F157, S172, F175, L176, R190, or Y265 of SARS-CoV-2 S protein RBD. In certain embodiments, described herein is an isolated antibody that binds all of the following residues: K417, F456, G476, F486, N487, or Y489 of SARS-CoV-2 S protein RBD. In certain embodiments, described herein is an isolated antibody that binds all of the following residues: I326, R328, T531, N532, L533, F543, L552, S555, F559, or F562 of SARS-CoV-2 S protein RBD. In certain embodiments, described herein is an isolated antibody that binds all of the following residues: N450, I472, or F490 of SARS-CoV-2 S protein RBD. In certain embodiments, described herein is an isolated antibody that binds all of the following residues: L452, I468, or F490 of SARS-CoV-2 S protein RBD. In certain embodiments, the antibody only binds residues that participate with the antibody in strong or medium interactions. In certain embodiments, the antibody only binds residues that participate with the antibody in strong interactions.

In certain embodiments, described herein is an antibody comprising CDRs with an amino acid sequence set forth in any one of SEQ ID NOs: 1-492, 547-721-779-1202, 1344-1883, and 2381-2596 that binds any one, two, three, four, five, six, seven, eight, nine, ten, eleven, twelve, thirteen, fourteen, fifteen, sixteen, seventeen, eighteen, nineteen, or twenty of the following residues: R102, N125, F157, S172, F175, L176, R190, Y265, I326, R328, K378, V382, S383, P384, K417, T430, N450, L452, F456, I468, I472, G476, F486, N487, Y489, F490, T531, N532, L533, F543, L552, S555, F559, or F562 of SARS-CoV-2 S protein RBD. In certain embodiments, described herein is an antibody comprising CDRs with an amino acid sequence set forth in any one of SEQ ID NOs: 1-492, 547-721-779-1202, 1344-1883, and 2381-2596 that binds any one, two, three, or four of the following residues: V382, S383, P384, or T430 of SARS-CoV-2 S protein RBD. In certain embodiments, described herein is an antibody comprising CDRs with an amino acid sequence set forth in any one of SEQ ID NOs: 1-492, 547-721-779-1202, 1344-1883, and 2381-2596 that binds any one or two of the following residues following residues K378 or P384 of SARS-CoV-2 S protein RBD. In certain embodiments, described herein is an antibody comprising CDRs with an amino acid sequence set forth in any one of SEQ ID NOs: 1-492, 547-721-779-1202, 1344-1883, and 2381-2596 that binds any one, two, three, four, five, six, seven, or eight of the following residues: R102, N125, F157, S172, F175, L176, R190, or Y265 of SARS-CoV-2 S protein RBD. In certain embodiments, described herein is an antibody comprising CDRs with an amino acid sequence set forth in any one of SEQ ID NOs: 1-492, 547-721-779-1202, 1344-1883, and 2381-2596 that binds any one, two, three, four, five, or six of the following residues: K417, F456, G476, F486, N487, or Y489 of SARS-CoV-2 S protein RBD. In certain embodiments, described herein is an antibody comprising CDRs with an amino acid sequence set forth in any one of SEQ ID NOs: 1-492, 547-721-779-1202, 1344-1883, and 2381-2596 that binds any one, two, three, four, five, six, seven, eight, nine, or ten of the following residues: I326, R328, T531, N532, L533, F543, L552, S555, F559, or F562 of SARS-CoV-2 S protein RBD. In certain embodiments, described herein is an antibody comprising CDRs with an amino acid sequence set forth in any one of SEQ ID NOs: 1-492, 547-721-779-1202, 1344-1883, and 2381-2596 that binds any one, two, or three of the following residues: N450, I472, or F490 of SARS-CoV-2 S protein RBD. In certain embodiments, described herein is an antibody comprising CDRs with an amino acid sequence set forth in any one of SEQ ID NOs: 1-492, 547-721-779-1202, 1344-1883, and 2381-2596 that binds any one, two, or three of the following residues: L452, I468, or F490 of SARS-CoV-2 S protein RBD. In certain embodiments, the antibody only binds residues that participate with the antibody in strong or medium interactions. In certain embodiments, the antibody only binds residues that participate with the antibody in strong interactions. In certain embodiments, the antibody only binds residues that participate with the antibody in strong or medium interactions. In certain embodiments, the antibody only binds residues that participate with the antibody in strong interactions.

In certain embodiments, described herein is an antibody comprising CDRs with an amino acid sequence set forth in any one of SEQ ID NOs: 1-492, 547-721-779-1202, 1344-1883, and 2381-2596 that binds to all of the following residues: R102, N125, F157, S172, F175, L176, R190, Y265, I326, R328, K378, V382, S383, P384, K417, T430, N450, L452, F456, I468, I472, G476, F486, N487, Y489, F490, T531, N532, L533, F543, L552, S555, F559, or F562 of SARS-CoV-2 S protein RBD. In certain embodiments, described herein is an antibody comprising CDRs with an amino acid sequence set forth in any one of SEQ ID NOs: 1-492, 547-721-779-1202, 1344-1883, and 2381-2596 that binds all of the following residues: V382, S383, P384, or T430 of SARS-CoV-2 S protein RBD. In certain embodiments, described herein is an antibody comprising CDRs with an amino acid sequence set forth in any one of SEQ ID NOs: 1-492, 547-721-779-1202, 1344-1883, and 2381-2596 that binds all of the following residues K378 or P384 of SARS-CoV-2 S protein RBD. In certain embodiments, described herein is an antibody comprising CDRs with an amino acid sequence set forth in any one of SEQ ID NOs: 1-492, 547-721-779-1202, 1344-1883, and 2381-2596 that binds all of the following residues: R102, N125, F157, S172, F175, L176, R190, or Y265 of SARS-CoV-2 S protein RBD. In certain embodiments, described herein is an antibody comprising CDRs with an amino acid sequence set forth in any one of SEQ ID NOs: 1-492, 547-721-779-1202, 1344-1883, and 2381-2596 that binds all of the following residues: K417, F456, G476, F486, N487, or Y489 of SARS-CoV-2 S protein RBD. In certain embodiments, described herein is an antibody comprising CDRs with an amino acid sequence set forth in any one of SEQ ID NOs: 1-492, 547-721-779-1202, 1344-1883, and 2381-2596 that binds all of the following residues: I326, R328, T531, N532, L533, F543, L552, S555, F559, or F562 of SARS-CoV-2 S protein RBD. In certain embodiments, described herein is an antibody comprising CDRs with an amino acid sequence set forth in any one of SEQ ID NOs: 1-492, 547-721-779-1202, 1344-1883, and 2381-2596 that binds all of the following residues: N450, I472, or F490 of SARS-CoV-2 S protein RBD. In certain embodiments, described herein is an antibody comprising CDRs with an amino acid sequence set forth in any one of SEQ ID NOs: 1-492, 547-721-779-1202, 1344-1883, and 2381-2596 that binds all of the following residues: L452, I468, or F490 of SARS-CoV-2 S protein RBD. In certain embodiments, the antibody only binds residues that participate with the antibody in strong or medium interactions. In certain embodiments, the antibody only binds residues that participate with the antibody in strong interactions. In certain embodiments, the antibody only binds residues that participate with the antibody in strong or medium interactions. In certain embodiments, the antibody only binds residues that participate with the antibody in strong interactions.

In certain embodiments, described herein is an antibody comprising CDRs with an amino acid sequence that differ from the amino acid sequence set forth in any one of SEQ ID NOs: 1-492, 547-721-779-1202, 1344-1883, and 2381-2596 by 1, 2, 3, 4, or 5 amino acids and that binds any one, two, three, four, five, six, seven, eight, nine, ten, eleven, twelve, thirteen, fourteen, fifteen, sixteen, seventeen, eighteen, nineteen, or twenty of the following residues: R102, N125, F157, S172, F175, L176, R190, Y265, I326, R328, K378, V382, S383, P384, K417, T430, N450, L452, F456, I468, I472, G476, F486, N487, Y489, F490, T531, N532, L533, F543, L552, S555, F559, or F562 of SARS-CoV-2 S protein RBD. In certain embodiments, described herein is an antibody comprising CDRs with an amino acid sequence that differ from the amino acid sequence set forth in any one of SEQ ID NOs: 1-492, 547-721-779-1202, 1344-1883, and 2381-2596 by 1, 2, 3, 4, or 5 amino acids and that binds any one, two, three, or four of the following residues: V382, S383, P384, or T430 of SARS-CoV-2 S protein RBD. In certain embodiments, described herein is an antibody comprising CDRs with an amino acid sequence that differ from the amino acid sequence set forth in any one of SEQ ID NOs: 1-492, 547-721-779-1202, 1344-1883, and 2381-2596 by 1, 2, 3, 4, or 5 amino acids and that binds any one or two of the following residues following residues K378 or P384 of SARS-CoV-2 S protein RBD. In certain embodiments, described herein is an antibody comprising CDRs with an amino acid sequence that differ from the amino acid sequence set forth in any one of SEQ ID NOs: 1-492, 547-721-779-1202, 1344-1883, and 2381-2596 by 1, 2, 3, 4, or 5 amino acids and that binds any one, two, three, four, five, six, seven, or eight of the following residues: R102, N125, F157, S172, F175, L176, R190, or Y265 of SARS-CoV-2 S protein RBD. In certain embodiments, described herein is an antibody comprising CDRs with an amino acid sequence that differ from the amino acid sequence set forth in any one of SEQ ID NOs: 1-492, 547-721-779-1202, 1344-1883, and 2381-2596 by 1, 2, 3, 4, or 5 amino acids and that binds any one, two, three, four, five, or six of the following residues: K417, F456, G476, F486, N487, or Y489 of SARS-CoV-2 S protein RBD. In certain embodiments, described herein is an antibody comprising CDRs with an amino acid sequence that differ from the amino acid sequence set forth in any one of SEQ ID NOs: 1-492, 547-721-779-1202, 1344-1883, and 2381-2596 by 1, 2, 3, 4, or 5 amino acids and that binds any one, two, three, four, five, six, seven, eight, nine, or ten of the following residues: I326, R328, T531, N532, L533, F543, L552, S555, F559, or F562 of SARS-CoV-2 S protein RBD. In certain embodiments, described herein is an antibody comprising CDRs with an amino acid sequence that differ from the amino acid sequence set forth in any one of SEQ ID NOs: 1-492, 547-721-779-1202, 1344-1883, and 2381-2596 by 1, 2, 3, 4, or 5 amino acids and that binds any one, two, or three of the following residues: N450, I472, or F490 of SARS-CoV-2 S protein RBD. In certain embodiments, described herein is an antibody comprising CDRs with an amino acid sequence that differ from the amino acid sequence set forth in any one of SEQ ID NOs: 1-492, 547-721, 779-1202, 1344-1883, and 2381-2596 by 1, 2, 3, 4, or 5 amino acids and that binds any one, two, or three of the following residues: L452, I468, or F490 of SARS-CoV-2 S protein RBD. In certain embodiments, the antibody only binds residues that participate with the antibody in strong or medium interactions. In certain embodiments, the antibody only binds residues that participate with the antibody in strong interactions. In certain embodiments, the antibody only binds residues that participate with the antibody in strong or medium interactions. In certain embodiments, the antibody only binds residues that participate with the antibody in strong interactions.

In certain embodiments, described herein is an antibody comprising CDRs with an amino acid sequence that differ from the amino acid sequence set forth in any one of SEQ ID NOs: 1-492, 547-721, 779-1202, 1344-1883, and 2381-2596 by 1, 2, 3, 4, or 5 amino acids and that binds to all of the following residues: R102, N125, F157, S172, F175, L176, R190, Y265, I326, R328, K378, V382, S383, P384, K417, T430, N450, L452, F456, I468, I472, G476, F486, N487, Y489, F490, T531, N532, L533, F543, L552, S555, F559, or F562 of SARS-CoV-2 S protein RBD. In In certain embodiments, described herein is an antibody comprising CDRs with an amino acid sequence that differ from the amino acid sequence set forth in any one of SEQ ID NOs: 1-492, 547-721, 779-1202, 1344-1883, and 2381-2596 by 1, 2, 3, 4, or 5 amino acids and that binds all of the following residues: V382, S383, P384, or T430 of SARS-CoV-2 S protein RBD. In certain embodiments, described herein is an antibody comprising CDRs with an amino acid sequence that differ from the amino acid sequence set forth in any one of SEQ ID NOs: 1-492, 547-721, 779-1202, 1344-1883, and 2381-2596 by 1, 2, 3, 4, or 5 amino acids and that binds all of the following residues K378 or P384 of SARS-CoV-2 S protein RBD. In certain embodiments, described herein is an antibody comprising CDRs with an amino acid sequence that differ from the amino acid sequence set forth in any one of SEQ ID NOs: 1-492, 547-721, 779-1202, 1344-1883, and 2381-2596 by 1, 2, 3, 4, or 5 amino acids and that binds all of the following residues: R102, N125, F157, S172, F175, L176, R190, or Y265 of SARS-CoV-2 S protein RBD. In certain embodiments, described herein is an antibody comprising CDRs with an amino acid sequence that differ from the amino acid sequence set forth in any one of SEQ ID NOs: 1-492, 547-721, 779-1202, 1344-1883, and 2381-2596 by 1, 2, 3, 4, or 5 amino acids and that binds all of the following residues: K417, F456, G476, F486, N487, or Y489 of SARS-CoV-2 S protein RBD. In certain embodiments, described herein is an antibody comprising CDRs with an amino acid sequence that differ from the amino acid sequence set forth in any one of SEQ ID NOs: 1-492, 547-721, 779-1202, 1344-1883, and 2381-2596 by 1, 2, 3, 4, or 5 amino acids and that binds all of the following residues: I326, R328, T531, N532, L533, F543, L552, S555, F559, or F562 of SARS-CoV-2 S protein RBD. In certain embodiments, described herein is an antibody comprising CDRs with an amino acid sequence that differ from the amino acid sequence set forth in any one of SEQ ID NOs: 1-492, 547-721, 779-1202, 1344-1883, and 2381-2596 by 1, 2, 3, 4, or 5 amino acids and that binds all of the following residues: N450, I472, or F490 of SARS-CoV-2 S protein RBD. In certain embodiments, described herein is an antibody comprising CDRs with an amino acid sequence that differ from the amino acid sequence set forth in any one of SEQ ID NOs: 1-492, 547-721, 779-1202, 1344-1883, and 2381-2596 by 1, 2, 3, 4, or 5 amino acids and that binds all of the following residues: L452, I468, or F490 of SARS-CoV-2 S protein RBD. In certain embodiments, the antibody only binds residues that participate with the antibody in strong or medium interactions. In certain embodiments, the antibody only binds residues that participate with the antibody in strong interactions. In certain embodiments, the antibody only binds residues that participate with the antibody in strong or medium interactions. In certain embodiments, the antibody only binds residues that participate with the antibody in strong interactions.

In certain embodiments, described herein is an antibody that specifically binds SARS-CoV-2 comprising a variable heavy chain amino acid sequence at least about 80%, about 90%, about 95%, about 97%, about 98%, or about 99% identical to the amino acid sequence set forth in any one of SEQ ID NOs: 493-519 and 721-749; and a variable light chain amino acid sequence at least about 80%, about 90%, about 95%, about 97%, about 98%, or about 99% identical to the amino acid sequence set forth in any one of SEQ ID NOs: 520-546 and 750-778 and binds any one, two, three, four, five, six, seven, eight, nine, ten, eleven, twelve, thirteen, fourteen, fifteen, sixteen, seventeen, eighteen, nineteen, or twenty of the following residues: R102, N125, F157, S172, F175, L176, R190, Y265, I326, R328, K378, V382, S383, P384, K417, T430, N450, L452, F456, I468, I472, G476, F486, N487, Y489, F490, T531, N532, L533, F543, L552, S555, F559, or F562 of SARS-CoV-2 S protein RBD. In certain embodiments, described herein is an antibody that specifically binds SARS-CoV-2 comprising a variable heavy chain amino acid sequence at least about 80%, about 90%, about 95%, about 97%, about 98%, or about 99% identical to the amino acid sequence set forth in any one of SEQ ID NOs: 493-519 and 721-749; and a variable light chain amino acid sequence at least about 80%, about 90%, about 95%, about 97%, about 98%, or about 99% identical to the amino acid sequence set forth in any one of SEQ ID NOs: 520-546 and 750-778 and binds all of the following residues: R102, N125, F157, S172, F175, L176, R190, Y265, I326, R328, K378, V382, S383, P384, K417, T430, N450, L452, F456, I468, I472, G476, F486, N487, Y489, F490, T531, N532, L533, F543, L552, S555, F559, or F562 of SARS-CoV-2 S protein RBD. In certain embodiments, the antibody only binds residues that that participate with the antibody in strong or medium interactions. In certain embodiments, the antibody only binds residues that that participate with the antibody in strong interactions.

In certain embodiments, described herein is an antibody that specifically binds SARS-CoV-2 comprising a variable heavy chain amino acid sequence at least about 80%, about 90%, about 95%, about 97%, about 98%, or about 99% identical to the amino acid sequence set forth in any one of SEQ ID NOs: 1884-1951, 1951-2063, 2302-2368, 2369-2380, 2597-2607, and 2608-2668 and binds any one, two, three, four, five, six, seven, eight, nine, ten, eleven, twelve, thirteen, fourteen, fifteen, sixteen, seventeen, eighteen, nineteen, or twenty of the following residues: R102, N125, F157, S172, F175, L176, R190, Y265, I326, R328, K378, V382, S383, P384, K417, T430, N450, L452, F456, I468, I472, G476, F486, N487, Y489, F490, T531, N532, L533, F543, L552, S555, F559, or F562 of SARS-CoV-2 S protein RBD. In certain embodiments, described herein is an antibody that specifically binds SARS-CoV-2 comprising a variable heavy chain amino acid sequence at least about 80%, about 90%, about 95%, about 97%, about 98%, or about 99% identical to the amino acid sequence set forth in any one of SEQ ID NOs: 1884-1951, 1951-2063, 2302-2368, 2369-2380, 2597-2607, and 2608-2668 and binds all of the following residues: R102, N125, F157, S172, F175, L176, R190, Y265, I326, R328, K378, V382, S383, P384, K417, T430, N450, L452, F456, I468, I472, G476, F486, N487, Y489, F490, T531, N532, L533, F543, L552, S555, F559, or F562 of SARS-CoV-2 S protein RBD. In certain embodiments, the antibody only binds residues that that participate with the antibody in strong or medium interactions. In certain embodiments, the antibody only binds residues that that participate with the antibody in strong interactions.

Diseases and Disorders

Provided herein are SARS-CoV-2 or ACE2 binding libraries comprising nucleic acids encoding for antibodies comprising SARS-CoV-2 or ACE2 binding domains may have therapeutic effects. In some instances, the SARS-CoV-2 or ACE2 binding libraries result in protein when translated that is used to treat a disease or disorder. In some instances, the protein is an immunoglobulin. In some instances, the protein is a peptidomimetic. In some instances, the disease or disorder is a viral infection caused by SARS-CoV-2. In some instances, the disease or disorder is a respiratory disease or disorder caused by SARS-CoV-2.

SARS-CoV-2 or ACE2 variant antibody libraries as described herein may be used to treat SARS-CoV-2. In some embodiments, the SARS-CoV-2 or ACE2 variant antibody libraries are used to treat or prevent symptoms of SARS-CoV-2. These symptoms include, but are not limited to, fever, chills, cough, fatigue, headaches, loss of taste, loss of smell, nausea, vomiting, muscle weakness, sleep difficulties, anxiety, and depression. In some embodiments, the SARS-CoV-2 or ACE2 variant antibody libraries are used to treat a subject who has symptoms for an extended period of time. In some embodiments, the subject has symptoms for an extended period of time after testing negative for SARS-CoV-2. In some embodiments, the subject has symptoms for an extended period of time including at least 1 week, 2 weeks, 3 weeks, 1 month, 2 months, 3 months, 4 months, 5 months, 6 months, 7 months, 8 months, 9 months, 10 months, 11 months, 1 year, or more than 1 year.

In some instances, the subject is a mammal. In some instances, the subject is a mouse, rabbit, dog, or human.

Subjects treated by methods described herein may be infants, adults, or children. Pharmaceutical compositions comprising antibodies or antibody fragments as described herein may be administered intravenously or subcutaneously. In some instances, a pharmaceutical composition comprises an antibody or antibody fragment described herein comprising a CDRH1 sequence of any one of SEQ ID NOs: 1-50, 779-919, 1344-1523, and 2381-2452. In some instances, a pharmaceutical composition comprises an antibody or antibody fragment described herein comprising a CDRH2 sequence of any one of SEQ ID NOs: 51-100, 920-1061, 1524-1703, and 2453-2524 In some instances, a pharmaceutical composition comprises an antibody or antibody fragment described herein comprising a CDRH3 sequence of any one of SEQ ID NOs: 101-150, 1062-1202, 1704-1883, and 2525-2596. In some instances, a pharmaceutical composition comprises an antibody or antibody fragment described herein comprising a variable domain, heavy chain region (VH) and a variable domain, light chain region (VL), wherein VH comprises complementarity determining regions CDRH1, CDRH2, and CDRH3, wherein VL comprises complementarity determining regions CDRL1, CDRL2, and CDRL3, and wherein (a) an amino acid sequence of CDRH1 is as set forth in any one of SEQ ID NOs: 151-165, 241-255, 331-357, and 547-575; (b) an amino acid sequence of CDRH2 is as set forth in any one of SEQ ID NOs: 166-180, 256-270, 358-384, and 576-604; (c) an amino acid sequence of CDRH3 is as set forth in any one of SEQ ID NOs: 181-195, 271-285, 385-411, and 605-633; (d) an amino acid sequence of CDRL1 is as set forth in any one of SEQ ID NOs: 196-210, 286-300, 412-438, and 634-662; (e) an amino acid sequence of CDRL2 is as set forth in any one of SEQ ID NOs: 211-225, 301-315, 439-465, and 663-691; and (f) an amino acid sequence of CDRL3 is as set forth in any one of SEQ ID NOs: 226-240, 316-330, 466-492, and 692-720. In some instances, a pharmaceutical composition comprises an antibody or antibody fragment described herein comprising a VH comprising at least or about 70%, 80%, 85%, 90%, 91%, 92%, 93%, 94%, 95%, 96%, 97%, 98%, 99%, or 100% sequence identity to any one of SEQ ID NOs: 493-519 and 721-749, and VL comprising at least or about 70%, 80%, 85%, 90%, 91%, 92%, 93%, 94%, 95%, 96%, 97%, 98%, 99%, or 100% sequence identity to any one of SEQ ID NOs: 520-546 and 750-778. In some instances, a pharmaceutical composition comprises an antibody or antibody fragment described herein comprising a heavy chain variable domain comprising at least or about 70%, 80%, 85%, 90%, 91%, 92%, 93%, 94%, 95%, 96%, 97%, 98%, 99%, or 100% sequence identity to any one of SEQ ID NOs: 1918-2058, 2599-2778, and 3095-3173.

SARS-CoV-2 or ACE2 antibodies as described herein may confer immunity after exposure to SARS-CoV-2 or ACE2 antibodies. In some embodiments, the SARS-CoV-2 or ACE2 antibodies described herein are used for passive immunization of a subject. In some instances, the subject is actively immunized after exposure to SARS-CoV-2 or ACE2 antibodies followed by exposure to SARS-CoV-2. In some embodiments, SARS-CoV-2 or ACE2 antibodies are derived from a subject who has recovered from SARS-CoV-2.

In some embodiments, the immunity occurs at least about 30 minutes, 1 hour, 5 hours, 10 hours, 16 hours, 20 hours, 24 hours, 2 days, 3 days, 4 days, 5 days, 6 days, 1 week, 2 weeks, or more than 2 weeks after exposure to SARS-CoV-2 or ACE2 antibodies. In some instances, the immunity lasts for at least about 1 day, 2 days, 3 days, 4 days, 5 days, 6 days, 1 week, 2 weeks, 3 weeks, 1 month, 2 months, 3 months, 4 months, 5 months, 6 months, 7 months, 8 months, 9 months, 10 months, 11 months, 1 year, 2 years, 3 years, 4 years, 5 years, or more than 5 years after exposure to SARS-CoV-2 or ACE2 antibodies.

In some embodiments, the subject receives the SARS-CoV-2 or ACE2 antibodies prior to exposure to SARS-CoV-2. In some embodiments, the subject receives the SARS-CoV-2 or ACE2 antibodies at least about 30 minutes, 1 hour, 4 hours, 8 hours, 12 hours, 16 hours, 20 hours, 1 day, 2 days, 3 days, 4 days, 5 days, 6 days, 1 week, 2 weeks, 3 weeks, 1 month, 2 months, 3 months, 4 months, 5 months, 6 months, 7 months, 8 months, 9 months, 10 months, 11 months, 1 year, 2 years, 3 years, 4 years, 5 years, or more than 5 years prior to exposure to SARS-CoV-2. In some embodiments, the subject receives the SARS-CoV-2 or ACE2 antibodies after exposure to SARS-CoV-2. In some embodiments, the subject receives the SARS-CoV-2 or ACE2 antibodies at least about 30 minutes, 1 hour, 4 hours, 8 hours, 12 hours, 16 hours, 20 hours, 1 day, 2 days, 3 days, 4 days, 5 days, 6 days, 1 week, 2 weeks, 3 weeks, 1 month, 2 months, 3 months, 4 months, 5 months, 6 months, 7 months, 8 months, 9 months, 10 months, 11 months, 1 year, 2 years, 3 years, 4 years, 5 years, or more than 5 years after exposure to SARS-CoV-2.

SARS-CoV-2 or ACE2 antibodies described herein may be administered through various routes. The administration may, depending on the composition being administered, for example, be oral, pulmonary, intravenous, intraperitoneal, intramuscular, intracavity, subcutaneous, or transdermal.

Described herein are compositions or pharmaceutical compositions comprising SARS-CoV-2 or ACE2 antibodies or antibody fragment thereof that comprise various dosages of the antibodies or antibody fragment. In some instances, the dosage is ranging from about 1 to 25 mg/kg, from about 1 to 50 mg/kg, from about 1 to 80 mg/kg, from about 1 to about 100 mg/kg, from about 5 to about 100 mg/kg, from about 5 to about 80 mg/kg, from about 5 to about 60 mg/kg, from about 5 to about 50 mg/kg or from about 5 to about 500 mg/kg which can be administered in single or multiple doses. In some instances, the dosage is administered in an amount of about 0.01 mg/kg, about 0.05 mg/kg, about 0.10 mg/kg, about 0.25 mg/kg, about 0.5 mg/kg, about 1 mg/kg, about 5 mg/kg, about 10 mg/kg, about 15 mg/kg, about 20 mg/kg, about 25 mg/kg, about 30 mg/kg, about 35 mg/kg, about 40 mg/kg, about 45 mg/kg, about 50 mg/kg, about 55 mg/kg, about 60 mg/kg, about 65 mg/kg, about 70 mg/kg, about 75 mg/kg, about 80 mg/kg, about 85 mg/kg, about 90 mg/kg, about 95 mg/kg, about 100 mg/kg, about 105 mg/kg, about 110 mg/kg, about 115 mg/kg, about 120, about 125, about 130, about 135, about 140, about 145, about 150, about 155, about 160, about 165, about 170, about 175, about 180, about 185, about 190, about 195, about 200, about 205, about 210, about 215, about 220, about 225, about 230, about 240, about 250, about 260, about 270, about 275, about 280, about 290, about 300, about 310, about 320, about 330, about 340, about 350, about 360 mg/kg, about 370 mg/kg, about 380 mg/kg, about 390 mg/kg, about 400 mg/kg, 410 mg/kg, about 420 mg/kg, about 430 mg/kg, about 440 mg/kg, about 450 mg/kg, about 460 mg/kg, about 470 mg/kg, about 480 mg/kg, about 490 mg/kg, or about 500 mg/kg.

SARS-CoV-2 or ACE2 antibodies or antibody fragment thereof described herein, in some embodiments, improve disease severity. In some embodiments, the SARS-CoV-2 or ACE2 antibodies or antibody fragment thereof improve disease severity at a dose level of about 0.01 mg/kg, about 0.05 mg/kg, about 0.10 mg/kg, about 0.25 mg/kg, about 0.5 mg/kg, about 1 mg/kg, about 5 mg/kg, about 10 mg/kg, about 15 mg/kg, or about 20 mg/kg. In some embodiments, the SARS-CoV-2 or ACE2 antibodies or antibody fragment thereof improve disease severity at a dose level of about 1 mg/kg, about 5 mg/kg, or about 10 mg/kg. In some embodiments, disease severity is determined by percent weight loss. In some embodiments, the SARS-CoV-2 or ACE2 antibodies or antibody fragment thereof protects against weight loss at a dose level of about 0.01 mg/kg, about 0.05 mg/kg, about 0.10 mg/kg, about 0.25 mg/kg, about 0.5 mg/kg, about 1 mg/kg, about 5 mg/kg, about 10 mg/kg, about 15 mg/kg, or about 20 mg/kg. In some embodiments, the SARS-CoV-2 or ACE2 antibodies or antibody fragment thereof protects against weight loss at a dose level of about 1 mg/kg, about 5 mg/kg, or about 10 mg/kg. In some embodiments, SARS-CoV-2 or ACE2 antibodies or antibody fragment thereof Variant Libraries Codon Variation Variant nucleic acid libraries described herein may comprise a plurality of nucleic acids, wherein each nucleic acid encodes for a variant codon sequence compared to a reference nucleic acid sequence. In some instances, each nucleic acid of a first nucleic acid population contains a variant at a single variant site. In some instances, the first nucleic acid population contains a plurality of variants at a single variant site such that the first nucleic acid population contains more than one variant at the same variant site. The first nucleic acid population may comprise nucleic acids collectively encoding multiple codon variants at the same variant site. The first nucleic acid population may comprise nucleic acids collectively encoding up to 19 or more codons at the same position. The first nucleic acid population may comprise nucleic acids collectively encoding up to 60 variant triplets at the same position, or the first nucleic acid population may comprise nucleic acids collectively encoding up to 61 different triplets of codons at the same position. Each variant may encode for a codon that results in a different amino acid during translation. Table 1 provides a listing of each codon possible (and the representative amino acid) for a variant site.

TABLE 1

List of codons and amino acids

| Amino Acids | One letter code | Three letter code | Codons |
|---|---|---|---|
| Alanine | A | Ala | GCA GCC GCG GCT |
| Cysteine | C | Cys | TGC TGT |
| Aspartic acid | D | Asp | GAC GAT |
| Glutamic acid | E | Glu | GAA GAG |
| Phenylalanine | F | Phe | TTC TTT |
| Glycine | G | Gly | GGA GGC GGG GGT |
| Histidine | H | His | CAC CAT |
| Isoleucine | I | Iso | ATA ATC ATT |
| Lysine | K | Lys | AAA AAG |
| Leucine | L | Leu | TTA TTG CTA CTC CTG CTT |

TABLE 1-continued

List of codons and amino acids

| Amino Acids | One letter code | Three letter code | Codons |
|---|---|---|---|
| Methionine | M | Met | ATG |
| Asparagine | N | Asn | AAC AAT |
| Proline | P | Pro | CCA CCC CCG CCT |
| Glutamine | Q | Gln | CAA CAG |
| Arginine | R | Arg | AGA AGG CGA CGC CGG CGT |
| Serine | S | Ser | AGC AGT TCA TCC TCG TCT |
| Threonine | T | Thr | ACA ACC ACG ACT |
| Valine | V | Val | GTA GTC GTG GTT |
| Tryptophan | W | Trp | TGG |
| Tyrosine | Y | Tyr | TAC TAT |

A nucleic acid population may comprise varied nucleic acids collectively encoding up to 20 codon variations at multiple positions. In such cases, each nucleic acid in the population comprises variation for codons at more than one position in the same nucleic acid. In some instances, each nucleic acid in the population comprises variation for codons at 1, 2, 3, 4, 5, 6, 7, 8, 9, 10, 11, 12, 13, 14, 15, 16, 17, 18, 19, 20 or more codons in a single nucleic acid. In some instances, each variant long nucleic acid comprises variation for codons at 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more codons in a single long nucleic acid. In some instances, the variant nucleic acid population comprises variation for codons at 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more codons in a single nucleic acid. In some instances, the variant nucleic acid population comprises variation for codons in at least about 10, 20, 30, 40, 50, 60, 70, 80, 90, 100 or more codons in a single long nucleic acid.

Highly Parallel Nucleic Acid Synthesis

Provided herein is a platform approach utilizing miniaturization, parallelization, and vertical integration of the end-to-end process from polynucleotide synthesis to gene assembly within nanowells on silicon to create a revolutionary synthesis platform. Devices described herein provide, with the same footprint as a 96-well plate, a silicon synthesis platform is capable of increasing throughput by a factor of up to 1,000 or more compared to traditional synthesis methods, with production of up to approximately 1,000,000 or more polynucleotides, or 10,000 or more genes in a single highly-parallelized run.

With the advent of next-generation sequencing, high resolution genomic data has become an important factor for studies that delve into the biological roles of various genes in both normal biology and disease pathogenesis. At the core of this research is the central dogma of molecular biology and the concept of "residue-by-residue transfer of sequential information." Genomic information encoded in the DNA is transcribed into a message that is then translated into the protein that is the active product within a given biological pathway.

Another exciting area of study is on the discovery, development and manufacturing of therapeutic molecules focused on a highly-specific cellular target. High diversity DNA sequence libraries are at the core of development pipelines for targeted therapeutics. Gene variants are used to express proteins in a design, build, and test protein engineering cycle that ideally culminates in an optimized gene for high expression of a protein with high affinity for its therapeutic target. As an example, consider the binding pocket of a receptor. The ability to test all sequence permutations of all residues within the binding pocket simultaneously will allow for a thorough exploration, increasing chances of success. Saturation mutagenesis, in which a researcher attempts to generate all possible mutations or variants at a specific site within the receptor, represents one approach to this development challenge. Though costly and time and labor-intensive, it enables each variant to be introduced into each position. In contrast, combinatorial mutagenesis, where a few selected positions or short stretch of DNA may be modified extensively, generates an incomplete repertoire of variants with biased representation.

To accelerate the drug development pipeline, a library with the desired variants available at the intended frequency in the right position available for testing—in other words, a precision library, enables reduced costs as well as turn-around time for screening. Provided herein are methods for synthesizing nucleic acid synthetic variant libraries which provide for precise introduction of each intended variant at the desired frequency. To the end user, this translates to the ability to not only thoroughly sample sequence space but also be able to query these hypotheses in an efficient manner, reducing cost and screening time. Genome-wide editing can elucidate important pathways, libraries where each variant and sequence permutation can be tested for optimal functionality, and thousands of genes can be used to reconstruct entire pathways and genomes to re-engineer biological systems for drug discovery.

In a first example, a drug itself can be optimized using methods described herein. For example, to improve a specified function of an antibody, a variant polynucleotide library encoding for a portion of the antibody is designed and synthesized. A variant nucleic acid library for the antibody can then be generated by processes described herein (e.g., PCR mutagenesis followed by insertion into a vector). The antibody is then expressed in a production cell line and screened for enhanced activity. Example screens include examining modulation in binding affinity to an antigen, stability, or effector function (e.g., ADCC, complement, or apoptosis). Exemplary regions to optimize the antibody include, without limitation, the Fc region, Fab region, variable region of the Fab region, constant region of the Fab region, variable domain of the heavy chain or light chain ($V_H$ or $V_L$), and specific complementarity-determining regions (CDRs) of $V_H$ or $V_L$.

Nucleic acid libraries synthesized by methods described herein may be expressed in various cells associated with a disease state. Cells associated with a disease state include cell lines, tissue samples, primary cells from a subject, cultured cells expanded from a subject, or cells in a model system. Exemplary model systems include, without limitation, plant and animal models of a disease state.

To identify a variant molecule associated with prevention, reduction or treatment of a disease state, a variant nucleic acid library described herein is expressed in a cell associated with a disease state, or one in which a cell a disease state can be induced. In some instances, an agent is used to induce a disease state in cells. Exemplary tools for disease state induction include, without limitation, a Cre/Lox recombination system, LPS inflammation induction, and streptozotocin to induce hypoglycemia. The cells associated with a disease state may be cells from a model system or cultured cells, as well as cells from a subject having a particular disease condition. Exemplary disease conditions include a bacterial, fungal, viral, autoimmune, or proliferative disorder (e.g., cancer). In some instances, the variant nucleic acid library is expressed in the model system, cell line, or primary cells derived from a subject, and screened for changes in at least one cellular activity. Exemplary cellular activities include, without limitation, proliferation, cycle progression, cell death, adhesion, migration, reproduction, cell signaling, energy production, oxygen utilization, metabolic activity, and aging, response to free radical damage, or any combination thereof Substrates Devices used as a surface for polynucleotide synthesis may be in the form of substrates which include, without limitation, homogenous array surfaces, patterned array surfaces, channels, beads, gels, and the like. Provided herein are substrates comprising a plurality of clusters, wherein each cluster comprises a plurality of loci that support the attachment and synthesis of polynucleotides. In some instances, substrates comprise a homogenous array surface. For example, the homogenous array surface is a homogenous plate. The term "locus" as used herein refers to a discrete region on a structure which provides support for polynucleotides encoding for a single predetermined sequence to extend from the surface. In some instances, a locus is on a two-dimensional surface, e.g., a substantially planar surface. In some instances, a locus is on a three-dimensional surface, e.g., a well, microwell, channel, or post. In some instances, a surface of a locus comprises a material that is actively functionalized to attach to at least one nucleotide for polynucleotide synthesis, or preferably, a population of identical nucleotides for synthesis of a population of polynucleotides. In some instances, polynucleotide refers to a population of polynucleotides encoding for the same nucleic acid sequence. In some cases, a surface of a substrate is inclusive of one or a plurality of surfaces of a substrate. The average error rates for polynucleotides synthesized within a library described here using the systems and methods provided are often less than 1 in 1000, less than about 1 in 2000, less than about 1 in 3000 or less often without error correction.

Provided herein are surfaces that support the parallel synthesis of a plurality of polynucleotides having different predetermined sequences at addressable locations on a common support. In some instances, a substrate provides support for the synthesis of more than 50, 100, 200, 400, 600, 800, 1000, 1200, 1400, 1600, 1800, 2,000; 5,000; 10,000; 20,000; 50,000; 100,000; 200,000; 300,000; 400,000; 500,000; 600,000; 700,000; 800,000; 900,000; 1,000,000; 1,200,000; 1,400,000; 1,600,000; 1,800,000; 2,000,000; 2,500,000; 3,000,000; 3,500,000; 4,000,000; 4,500,000; 5,000,000; 10,000,000 or more non-identical polynucleotides. In some cases, the surfaces provide support for the synthesis of more than 50, 100, 200, 400, 600, 800, 1000, 1200, 1400, 1600, 1800, 2,000; 5,000; 10,000; 20,000; 50,000; 100,000; 200,000; 300,000; 400,000; 500,000; 600,000; 700,000; 800,000; 900,000; 1,000,000; 1,200,000; 1,400,000; 1,600,000; 1,800,000; 2,000,000; 2,500,000; 3,000,000; 3,500,000; 4,000,000; 4,500,000; 5,000,000; 10,000,000 or more polynucleotides encoding for distinct sequences. In some instances, at least a portion of the polynucleotides have an identical sequence or are configured to be synthesized with an identical sequence. In some instances, the substrate provides a surface environment for the growth of polynucleotides having at least 80, 90, 100, 120, 150, 175, 200, 225, 250, 275, 300, 325, 350, 375, 400, 425, 450, 475, 500 bases or more.

Provided herein are methods for polynucleotide synthesis on distinct loci of a substrate, wherein each locus supports the synthesis of a population of polynucleotides. In some cases, each locus supports the synthesis of a population of polynucleotides having a different sequence than a population of polynucleotides grown on another locus. In some instances, each polynucleotide sequence is synthesized with 1, 2, 3, 4, 5, 6, 7, 8, 9 or more redundancy across different loci within the same cluster of loci on a surface for polynucleotide synthesis. In some instances, the loci of a substrate are located within a plurality of clusters. In some instances, a substrate comprises at least 10, 500, 1000, 2000, 3000, 4000, 5000, 6000, 7000, 8000, 9000, 10000, 11000, 12000, 13000, 14000, 15000, 20000, 30000, 40000, 50000 or more clusters. In some instances, a substrate comprises more than 2,000; 5,000; 10,000; 100,000; 200,000; 300,000; 400,000; 500,000; 600,000; 700,000; 800,000; 900,000; 1,000,000; 1,100,000; 1,200,000; 1,300,000; 1,400,000; 1,500,000; 1,600,000; 1,700,000; 1,800,000; 1,900,000; 2,000,000; 300,000; 400,000; 500,000; 600,000; 700,000; 800,000; 900,000; 1,000,000; 1,200,000; 1,400,000; 1,600,000; 1,800,000; 2,000,000; 2,500,000; 3,000,000; 3,500,000; 4,000,000; 4,500,000; 5,000,000; or 10,000,000 or more distinct loci. In some instances, a substrate comprises about 10,000 distinct loci. The number of loci within a single cluster is varied in different instances. In some cases, each cluster includes 1, 2, 3, 4, 5, 6, 7, 8, 9, 10, 20, 30, 40, 50, 60, 70, 80, 90, 100, 120, 130, 150, 200, 300, 400, 500 or more loci. In some instances, each cluster includes about 50-500 loci. In some instances, each cluster includes about 100-200 loci. In some instances, each cluster includes about 100-150 loci. In some instances, each cluster includes about 109, 121, 130 or 137 loci. In some instances, each cluster includes about 19, 20, 61, 64 or more loci. Alternatively or in combination, polynucleotide synthesis occurs on a homogenous array surface.

In some instances, the number of distinct polynucleotides synthesized on a substrate is dependent on the number of distinct loci available in the substrate. In some instances, the density of loci within a cluster or surface of a substrate is at least or about 1, 10, 25, 50, 65, 75, 100, 130, 150, 175, 200, 300, 400, 500, 1,000 or more loci per mm$^2$. In some cases, a substrate comprises 10-500, 25-400, 50-500, 100-500, 150-500, 10-250, 50-250, 10-200, or 50-200 mm$^2$. In some instances, the distance between the centers of two adjacent loci within a cluster or surface is from about 10-500, from about 10-200, or from about 10-100 um. In some instances, the distance between two centers of adjacent loci is greater than about 10, 20, 30, 40, 50, 60, 70, 80, 90 or 100 um. In some instances, the distance between the centers of two adjacent loci is less than about 200, 150, 100, 80, 70, 60, 50, 40, 30, 20 or 10 um. In some instances, each locus has a width of about 0.5, 1, 2, 3, 4, 5, 6, 7, 8, 9, 10, 20, 30, 40, 50, 60, 70, 80, 90 or 100 um. In some cases, each locus has a width of about 0.5-100, 0.5-50, 10-75, or 0.5-50 um.

In some instances, the density of clusters within a substrate is at least or about 1 cluster per 100 mm$^2$, 1 cluster per 10 mm$^2$, 1 cluster per 5 mm$^2$, 1 cluster per 4 mm$^2$, 1 cluster per 3 mm$^2$, 1 cluster per 2 mm$^2$, 1 cluster per 1 mm$^2$, 2 clusters per 1 mm$^2$, 3 clusters per 1 mm$^2$, 4 clusters per 1 mm$^2$, 5 clusters per 1 mm$^2$, 10 clusters per 1 mm$^2$, 50 clusters per 1 mm$^2$ or more. In some instances, a substrate comprises from about 1 cluster per 10 mm$^2$ to about 10 clusters per 1 mm$^2$. In some instances, the distance between the centers of two adjacent clusters is at least or about 50, 100, 200, 500, 1000, 2000, or 5000 um. In some cases, the distance between the centers of two adjacent clusters is between about 50-100, 50-200, 50-300, 50-500, and 100-2000 um. In some cases, the distance between the centers of two adjacent clusters is between about 0.05-50, 0.05-10, 0.05-5, 0.05-4, 0.05-3, 0.05-2, 0.1-10, 0.2-10, 0.3-10, 0.4-10, 0.5-10, 0.5-5, or 0.5-2 mm. In some cases, each cluster has a cross section of about 0.5 to about 2, about 0.5 to about 1, or about 1 to about 2 mm. In some cases, each cluster has a cross section of about 0.5, 0.6, 0.7, 0.8, 0.9, 1, 1.1, 1.2, 1.3, 1.4, 1.5, 1.6, 1.7, 1.8, 1.9 or 2 mm. In some cases, each cluster has an interior cross section of about 0.5, 0.6, 0.7, 0.8, 0.9, 1, 1.1, 1.15, 1.2, 1.3, 1.4, 1.5, 1.6, 1.7, 1.8, 1.9 or 2 mm.

In some instances, a substrate is about the size of a standard 96 well plate, for example between about 100 and about 200 mm by between about 50 and about 150 mm. In some instances, a substrate has a diameter less than or equal to about 1000, 500, 450, 400, 300, 250, 200, 150, 100 or 50 mm. In some instances, the diameter of a substrate is between about 25-1000, 25-800, 25-600, 25-500, 25-400, 25-300, or 25-200 mm. In some instances, a substrate has a planar surface area of at least about 100; 200; 500; 1,000; 2,000; 5,000; 10,000; 12,000; 15,000; 20,000; 30,000; 40,000; 50,000 mm$^2$ or more. In some instances, the thickness of a substrate is between about 50-2000, 50-1000, 100-1000, 200-1000, or 250-1000 mm.

Surface Materials

Substrates, devices, and reactors provided herein are fabricated from any variety of materials suitable for the methods, compositions, and systems described herein. In certain instances, substrate materials are fabricated to exhibit a low level of nucleotide binding. In some instances, substrate materials are modified to generate distinct surfaces that exhibit a high level of nucleotide binding. In some instances, substrate materials are transparent to visible and/or UV light. In some instances, substrate materials are sufficiently conductive, e.g., are able to form uniform electric fields across all or a portion of a substrate. In some instances, conductive materials are connected to an electric ground. In some instances, the substrate is heat conductive or insulated. In some instances, the materials are chemical resistant and heat resistant to support chemical or biochemical reactions, for example polynucleotide synthesis reaction processes. In some instances, a substrate comprises flexible materials. For flexible materials, materials can include, without limitation: nylon, both modified and unmodified, nitrocellulose, polypropylene, and the like. In some instances, a substrate comprises rigid materials. For rigid materials, materials can include, without limitation: glass; fuse silica; silicon, plastics (for example polytetrafluoroethylene, polypropylene, polystyrene, polycarbonate, and blends thereof, and the like); metals (for example, gold, platinum, and the like). The substrate, solid support or reactors can be fabricated from a material selected from the group consisting of silicon, polystyrene, agarose, dextran, cellulosic polymers, polyacrylamides, polydimethylsiloxane (PDMS), and glass. The substrates/solid supports or the microstructures, reactors therein may be manufactured with a combination of materials listed herein or any other suitable material known in the art.

Surface Architecture

Provided herein are substrates for the methods, compositions, and systems described herein, wherein the substrates have a surface architecture suitable for the methods, compositions, and systems described herein. In some instances, a substrate comprises raised and/or lowered features. One benefit of having such features is an increase in surface area to support polynucleotide synthesis. In some instances, a substrate having raised and/or lowered features is referred to as a three-dimensional substrate. In some cases, a three-dimensional substrate comprises one or more channels. In some cases, one or more loci comprise a channel. In some cases, the channels are accessible to reagent deposition via a deposition device such as a material deposition device. In some cases, reagents and/or fluids collect in a larger well in fluid communication one or more channels. For example, a substrate comprises a plurality of channels corresponding to a plurality of loci with a cluster, and the plurality of channels are in fluid communication with one well of the cluster. In some methods, a library of polynucleotides is synthesized in a plurality of loci of a cluster.

Provided herein are substrates for the methods, compositions, and systems described herein, wherein the substrates are configured for polynucleotide synthesis. In some instances, the structure is configured to allow for controlled flow and mass transfer paths for polynucleotide synthesis on a surface. In some instances, the configuration of a substrate allows for the controlled and even distribution of mass transfer paths, chemical exposure times, and/or wash efficacy during polynucleotide synthesis. In some instances, the configuration of a substrate allows for increased sweep efficiency, for example by providing sufficient volume for a growing polynucleotide such that the excluded volume by the growing polynucleotide does not take up more than 50, 45, 40, 35, 30, 25, 20, 15, 14, 13, 12, 11, 10, 9, 8, 7, 6, 5, 4, 3, 2, 1%, or less of the initially available volume that is available or suitable for growing the polynucleotide. In some instances, a three-dimensional structure allows for managed flow of fluid to allow for the rapid exchange of chemical exposure.

Provided herein are substrates for the methods, compositions, and systems described herein, wherein the substrates comprise structures suitable for the methods, compositions, and systems described herein. In some instances, segregation is achieved by physical structure. In some instances, segregation is achieved by differential functionalization of the surface generating active and passive regions for polynucleotide synthesis. In some instances, differential functionalization is achieved by alternating the hydrophobicity across the substrate surface, thereby creating water contact angle effects that cause beading or wetting of the deposited reagents. Employing larger structures can decrease splashing and cross-contamination of distinct polynucleotide synthesis locations with reagents of the neighboring spots. In some cases, a device, such as a material deposition device, is used to deposit reagents to distinct polynucleotide synthesis locations. Substrates having three-dimensional features are configured in a manner that allows for the synthesis of a large number of polynucleotides (e.g., more than about 10,000) with a low error rate (e.g., less than about 1:500, 1:1000, 1:1500, 1:2,000, 1:3,000, 1:5,000, or 1:10,000). In some cases, a substrate comprises features with a density of about or greater than about 1, 5, 10, 20, 30, 40, 50, 60, 70, 80, 100, 110, 120, 130, 140, 150, 160, 170, 180, 190, 200, 300, 400 or 500 features per mm$^2$.

A well of a substrate may have the same or different width, height, and/or volume as another well of the substrate. A channel of a substrate may have the same or different width, height, and/or volume as another channel of the substrate. In some instances, the diameter of a cluster or the diameter of a well comprising a cluster, or both, is between about 0.05-50, 0.05-10, 0.05-5, 0.05-4, 0.05-3, 0.05-2, 0.05-1, 0.05-0.5, 0.05-0.1, 0.1-10, 0.2-10, 0.3-10, 0.4-10, 0.5-10, 0.5-5, or 0.5-2 mm. In some instances, the diameter of a cluster or well or both is less than or about 5, 4, 3, 2, 1, 0.5, 0.1, 0.09, 0.08, 0.07, 0.06, or 0.05 mm. In some instances, the diameter of a cluster or well or both is between about 1.0 and 1.3 mm. In some instances, the diameter of a cluster or well, or both is about 1.150 mm. In some instances, the diameter of a cluster or well, or both is about 0.08 mm. The diameter of a cluster refers to clusters within a two-dimensional or three-dimensional substrate.

In some instances, the height of a well is from about 20-1000, 50-1000, 100-1000, 200-1000, 300-1000, 400-1000, or 500-1000 um. In some cases, the height of a well is less than about 1000, 900, 800, 700, or 600 um.

In some instances, a substrate comprises a plurality of channels corresponding to a plurality of loci within a cluster, wherein the height or depth of a channel is 5-500, 5-400, 5-300, 5-200, 5-100, 5-50, or 10-50 um. In some cases, the height of a channel is less than 100, 80, 60, 40, or 20 um.

In some instances, the diameter of a channel, locus (e.g., in a substantially planar substrate) or both channel and locus (e.g., in a three-dimensional substrate wherein a locus corresponds to a channel) is from about 1-1000, 1-500, 1-200, 1-100, 5-100, or 10-100 um, for example, about 90, 80, 70, 60, 50, 40, 30, 20 or 10 um. In some instances, the diameter of a channel, locus, or both channel and locus is less than about 100, 90, 80, 70, 60, 50, 40, 30, 20 or 10 um. In some instances, the distance between the center of two adjacent channels, loci, or channels and loci is from about 1-500, 1-200, 1-100, 5-200, 5-100, 5-50, or 5-30, for example, about 20 um.

Surface Modifications

Provided herein are methods for polynucleotide synthesis on a surface, wherein the surface comprises various surface modifications. In some instances, the surface modifications are employed for the chemical and/or physical alteration of a surface by an additive or subtractive process to change one or more chemical and/or physical properties of a substrate surface or a selected site or region of a substrate surface. For example, surface modifications include, without limitation, (1) changing the wetting properties of a surface, (2) functionalizing a surface, i.e., providing, modifying or substituting surface functional groups, (3) defunctionalizing a surface, i.e., removing surface functional groups, (4) otherwise altering the chemical composition of a surface, e.g., through etching, (5) increasing or decreasing surface roughness, (6) providing a coating on a surface, e.g., a coating that exhibits wetting properties that are different from the wetting properties of the surface, and/or (7) depositing particulates on a surface.

In some cases, the addition of a chemical layer on top of a surface (referred to as adhesion promoter) facilitates structured patterning of loci on a surface of a substrate. Exemplary surfaces for application of adhesion promotion include, without limitation, glass, silicon, silicon dioxide and silicon nitride. In some cases, the adhesion promoter is a chemical with a high surface energy. In some instances, a second chemical layer is deposited on a surface of a substrate. In some cases, the second chemical layer has a low surface energy. In some cases, surface energy of a chemical layer coated on a surface supports localization of droplets on the surface. Depending on the patterning arrangement selected, the proximity of loci and/or area of fluid contact at the loci are alterable.

In some instances, a substrate surface, or resolved loci, onto which nucleic acids or other moieties are deposited, e.g., for polynucleotide synthesis, are smooth or substantially planar (e.g., two-dimensional) or have irregularities, such as raised or lowered features (e.g., three-dimensional features). In some instances, a substrate surface is modified with one or more different layers of compounds. Such modification layers of interest include, without limitation, inorganic and organic layers such as metals, metal oxides, polymers, small organic molecules and the like.

In some instances, resolved loci of a substrate are functionalized with one or more moieties that increase and/or decrease surface energy. In some cases, a moiety is chemically inert. In some cases, a moiety is configured to support a desired chemical reaction, for example, one or more processes in a polynucleotide synthesis reaction. The surface energy, or hydrophobicity, of a surface is a factor for determining the affinity of a nucleotide to attach onto the surface. In some instances, a method for substrate functionalization comprises: (a) providing a substrate having a surface that comprises silicon dioxide; and (b) silanizing the surface using, a suitable silanizing agent described herein or otherwise known in the art, for example, an organofunctional alkoxysilane molecule. Methods and functionalizing agents are described in U.S. Pat. No. 5,474,796, which is herein incorporated by reference in its entirety.

In some instances, a substrate surface is functionalized by contact with a derivatizing composition that contains a mixture of silanes, under reaction conditions effective to couple the silanes to the substrate surface, typically via reactive hydrophilic moieties present on the substrate surface. Silanization generally covers a surface through self-assembly with organofunctional alkoxysilane molecules. A variety of siloxane functionalizing reagents can further be used as currently known in the art, e.g., for lowering or increasing surface energy. The organofunctional alkoxysilanes are classified according to their organic functions.

Polynucleotide Synthesis

Methods of the current disclosure for polynucleotide synthesis may include processes involving phosphoramidite chemistry. In some instances, polynucleotide synthesis comprises coupling a base with phosphoramidite. Polynucleotide synthesis may comprise coupling a base by deposition of phosphoramidite under coupling conditions, wherein the same base is optionally deposited with phosphoramidite more than once, i.e., double coupling. Polynucleotide synthesis may comprise capping of unreacted sites. In some instances, capping is optional. Polynucleotide synthesis may also comprise oxidation or an oxidation step or oxidation steps. Polynucleotide synthesis may comprise deblocking, detritylation, and sulfurization. In some instances, polynucleotide synthesis comprises either oxidation or sulfurization. In some instances, between one or each step during a polynucleotide synthesis reaction, the device is washed, for example, using tetrazole or acetonitrile. Time frames for any one step in a phosphoramidite synthesis method may be less than about 2 min, 1 min, 50 sec, 40 sec, 30 sec, 20 sec and 10 sec.

Polynucleotide synthesis using a phosphoramidite method may comprise a subsequent addition of a phosphoramidite building block (e.g., nucleoside phosphoramidite) to a growing polynucleotide chain for the formation of a phosphite triester linkage. Phosphoramidite polynucleotide synthesis proceeds in the 3' to 5' direction. Phosphoramidite polynucleotide synthesis allows for the controlled addition of one nucleotide to a growing nucleic acid chain per synthesis cycle. In some instances, each synthesis cycle comprises a coupling step. Phosphoramidite coupling involves the formation of a phosphite triester linkage between an activated nucleoside phosphoramidite and a nucleoside bound to the substrate, for example, via a linker. In some instances, the nucleoside phosphoramidite is provided to the device activated. In some instances, the nucleoside phosphoramidite is provided to the device with an activator. In some instances, nucleoside phosphoramidites are provided to the device in a 1.5, 2, 3, 4, 5, 6, 7, 8, 9, 10, 11, 12, 13, 14, 15, 16, 17, 18, 19, 20, 25, 30, 35, 40, 50, 60, 70, 80, 90, 100-fold excess or more over the substrate-bound nucleosides. In some instances, the addition of nucleoside phosphoramidite is performed in an anhydrous environment, for example, in anhydrous acetonitrile. Following addition of a nucleoside phosphoramidite, the device is optionally washed. In some instances, the coupling step is repeated one or more additional times, optionally with a wash step between nucleoside phosphoramidite additions to the substrate. In some instances, a polynucleotide synthesis method used herein comprises 1, 2, 3 or more sequential coupling steps. Prior to coupling, in many cases, the nucleoside bound to the device is deprotected by removal of a protecting group, where the protecting group functions to prevent polymerization. A common protecting group is 4,4'-dimethoxytrityl (DMT).

Following coupling, phosphoramidite polynucleotide synthesis methods optionally comprise a capping step. In a capping step, the growing polynucleotide is treated with a capping agent. A capping step is useful to block unreacted substrate-bound 5'-OH groups after coupling from further chain elongation, preventing the formation of polynucleotides with internal base deletions. Further, phosphoramidites activated with 1H-tetrazole may react, to a small extent, with the O6 position of guanosine. Without being bound by theory, upon oxidation with $I_2$/water, this side product, possibly via O6-N7 migration, may undergo depurination. The apurinic sites may end up being cleaved in the course of the final deprotection of the polynucleotide thus reducing the yield of the full-length product. The O6 modifications may be removed by treatment with the capping reagent prior to oxidation with $I_2$/water. In some instances, inclusion of a capping step during polynucleotide synthesis decreases the error rate as compared to synthesis without capping. As an example, the capping step comprises treating the substrate-bound polynucleotide with a mixture of acetic anhydride and 1-methylimidazole. Following a capping step, the device is optionally washed.

In some instances, following addition of a nucleoside phosphoramidite, and optionally after capping and one or more wash steps, the device bound growing nucleic acid is oxidized. The oxidation step comprises the phosphite triester is oxidized into a tetracoordinated phosphate triester, a protected precursor of the naturally occurring phosphate diester internucleoside linkage. In some instances, oxidation of the growing polynucleotide is achieved by treatment with iodine and water, optionally in the presence of a weak base (e.g., pyridine, lutidine, collidine). Oxidation may be carried out under anhydrous conditions using, e.g. tert-Butyl hydroperoxide or (1S)-(+)-(10-camphorsulfonyl)-oxaziridine (CSO). In some methods, a capping step is performed following oxidation. A second capping step allows for device drying, as residual water from oxidation that may persist can inhibit subsequent coupling. Following oxidation, the device and growing polynucleotide is optionally washed. In some instances, the step of oxidation is substituted with a sulfurization step to obtain polynucleotide phosphorothioates, wherein any capping steps can be performed after the sulfurization. Many reagents are capable of the efficient sulfur transfer, including but not limited to 3-(Dimethylaminomethylidene)amino)-3H-1,2,4-dithiazole-3-thione, DDTT, 3H-1,2-benzodithiol-3-one 1,1-dioxide, also known as Beaucage reagent, and N,N,N'N'-Tetraethylthiuram disulfide (TETD).

In order for a subsequent cycle of nucleoside incorporation to occur through coupling, the protected 5' end of the device bound growing polynucleotide is removed so that the primary hydroxyl group is reactive with a next nucleoside phosphoramidite. In some instances, the protecting group is DMT and deblocking occurs with trichloroacetic acid in dichloromethane. Conducting detritylation for an extended time or with stronger than recommended solutions of acids may lead to increased depurination of solid support-bound polynucleotide and thus reduces the yield of the desired full-length product. Methods and compositions of the disclosure described herein provide for controlled deblocking conditions limiting undesired depurination reactions. In some instances, the device bound polynucleotide is washed after deblocking. In some instances, efficient washing after deblocking contributes to synthesized polynucleotides having a low error rate.

Methods for the synthesis of polynucleotides typically involve an iterating sequence of the following steps: application of a protected monomer to an actively functionalized surface (e.g., locus) to link with either the activated surface, a linker or with a previously deprotected monomer; deprotection of the applied monomer so that it is reactive with a subsequently applied protected monomer; and application of another protected monomer for linking. One or more intermediate steps include oxidation or sulfurization. In some instances, one or more wash steps precede or follow one or all of the steps.

Methods for phosphoramidite-based polynucleotide synthesis comprise a series of chemical steps. In some instances, one or more steps of a synthesis method involve reagent cycling, where one or more steps of the method comprise application to the device of a reagent useful for the step. For example, reagents are cycled by a series of liquid deposition and vacuum drying steps. For substrates comprising three-dimensional features such as wells, microwells, channels and the like, reagents are optionally passed through one or more regions of the device via the wells and/or channels.

Methods and systems described herein relate to polynucleotide synthesis devices for the synthesis of polynucleotides. The synthesis may be in parallel. For example, at least or about at least 2, 3, 4, 5, 6, 7, 8, 9, 10, 11, 12, 13, 14, 15, 16, 17, 18, 19, 20, 21, 22, 23, 24, 25, 30, 35, 40, 45, 50, 100, 150, 200, 250, 300, 350, 400, 450, 500, 550, 600, 650, 700, 750, 800, 850, 900, 1000, 10000, 50000, 75000, 100000 or more polynucleotides can be synthesized in parallel. The total number polynucleotides that may be synthesized in parallel may be from 2-100000, 3-50000, 4-10000, 5-1000, 6-900, 7-850, 8-800, 9-750, 10-700, 11-650, 12-600, 13-550, 14-500, 15-450, 16-400, 17-350, 18-300, 19-250, 20-200, 21-150,22-100, 23-50, 24-45, 25-40, 30-35. Those of skill in the art appreciate that the total number of polynucleotides synthesized in parallel may fall within any range bound by any of these values, for example 25-100. The total number of polynucleotides synthesized in parallel may fall within any range defined by any of the values serving as endpoints of the range. Total molar mass of polynucleotides synthesized within the device or the molar mass of each of the polynucleotides may be at least or at least about 10, 20, 30, 40, 50, 100, 250, 500, 750, 1000, 2000, 3000, 4000, 5000, 6000, 7000, 8000, 9000, 10000, 25000, 50000, 75000, 100000 picomoles, or more. The length of each of the polynucleotides or average length of the polynucleotides within the device may be at least or about at least 10, 15, 20, 25, 30, 35, 40, 45, 50, 100, 150, 200, 300, 400, 500 nucleotides, or more. The length of each of the polynucleotides or average length of the polynucleotides within the device may be at most or about at most 500, 400, 300, 200, 150, 100, 50, 45, 35, 30, 25, 20, 19, 18, 17, 16, 15, 14, 13, 12, 11, 10 nucleotides, or less. The length of each of the polynucleotides or average length of the polynucleotides within the device may fall from 10-500, 9-400, 11-300, 12-200, 13-150, 14-100, 15-50, 16-45, 17-40, 18-35, 19-25. Those of skill in the art appreciate that the length of each of the polynucleotides or average length of the polynucleotides within the device may fall within any range bound by any of these values, for example 100-300. The length of each of the polynucleotides or average length of the polynucleotides within the device may fall within any range defined by any of the values serving as endpoints of the range.

Methods for polynucleotide synthesis on a surface provided herein allow for synthesis at a fast rate. As an example, at least 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 70, 80, 90, 100, 125, 150, 175, 200 nucleotides per hour, or more are synthesized. Nucleotides include adenine, guanine, thymine, cytosine, uridine building blocks, or analogs/modified versions thereof. In some instances, libraries of polynucleotides are synthesized in parallel on substrate. For example, a device comprising about or at least about 100; 1,000; 10,000; 30,000; 75,000; 100,000; 1,000,000; 2,000,000; 3,000,000; 4,000,000; or 5,000,000 resolved loci is able to support the synthesis of at least the same number of distinct polynucleotides, wherein polynucleotide encoding a distinct sequence is synthesized on a resolved locus. In some instances, a library of polynucleotides is synthesized on a device with low error rates described herein in less than about three months, two months, one month, three weeks, 15, 14, 13, 12, 11, 10, 9, 8, 7, 6, 5, 4, 3, 2 days, 24 hours or less. In some instances, larger nucleic acids assembled from a polynucleotide library synthesized with low error rate using the substrates and methods described herein are prepared in less than about three months, two months, one month, three weeks, 15, 14, 13, 12, 11, 10, 9, 8, 7, 6, 5, 4, 3, 2 days, 24 hours or less.

In some instances, methods described herein provide for generation of a library of nucleic acids comprising variant nucleic acids differing at a plurality of codon sites. In some instances, a nucleic acid may have 1 site, 2 sites, 3 sites, 4 sites, 5 sites, 6 sites, 7 sites, 8 sites, 9 sites, 10 sites, 11 sites, 12 sites, 13 sites, 14 sites, 15 sites, 16 sites, 17 sites 18 sites, 19 sites, 20 sites, 30 sites, 40 sites, 50 sites, or more of variant codon sites.

In some instances, the one or more sites of variant codon sites may be adjacent. In some instances, the one or more sites of variant codon sites may not be adjacent and separated by 1, 2, 3, 4, 5, 6, 7, 8, 9, 10, or more codons.

In some instances, a nucleic acid may comprise multiple sites of variant codon sites, wherein all the variant codon sites are adjacent to one another, forming a stretch of variant codon sites. In some instances, a nucleic acid may comprise multiple sites of variant codon sites, wherein none the variant codon sites are adjacent to one another. In some instances, a nucleic acid may comprise multiple sites of variant codon sites, wherein some the variant codon sites are adjacent to one another, forming a stretch of variant codon sites, and some of the variant codon sites are not adjacent to one another.

Figure 1:
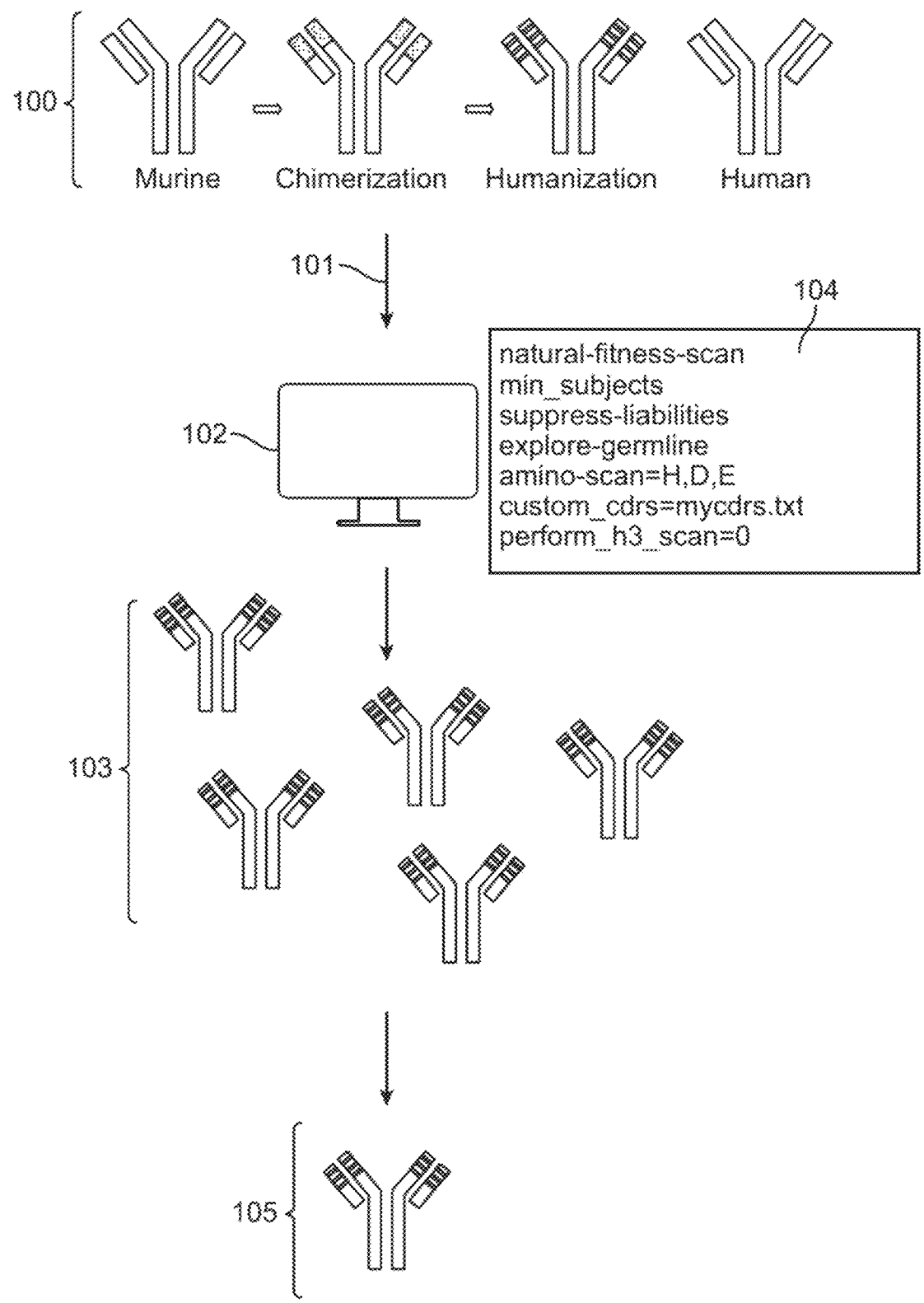
FIG. 1 depicts a workflow for antibody optimization.
Figure 2:
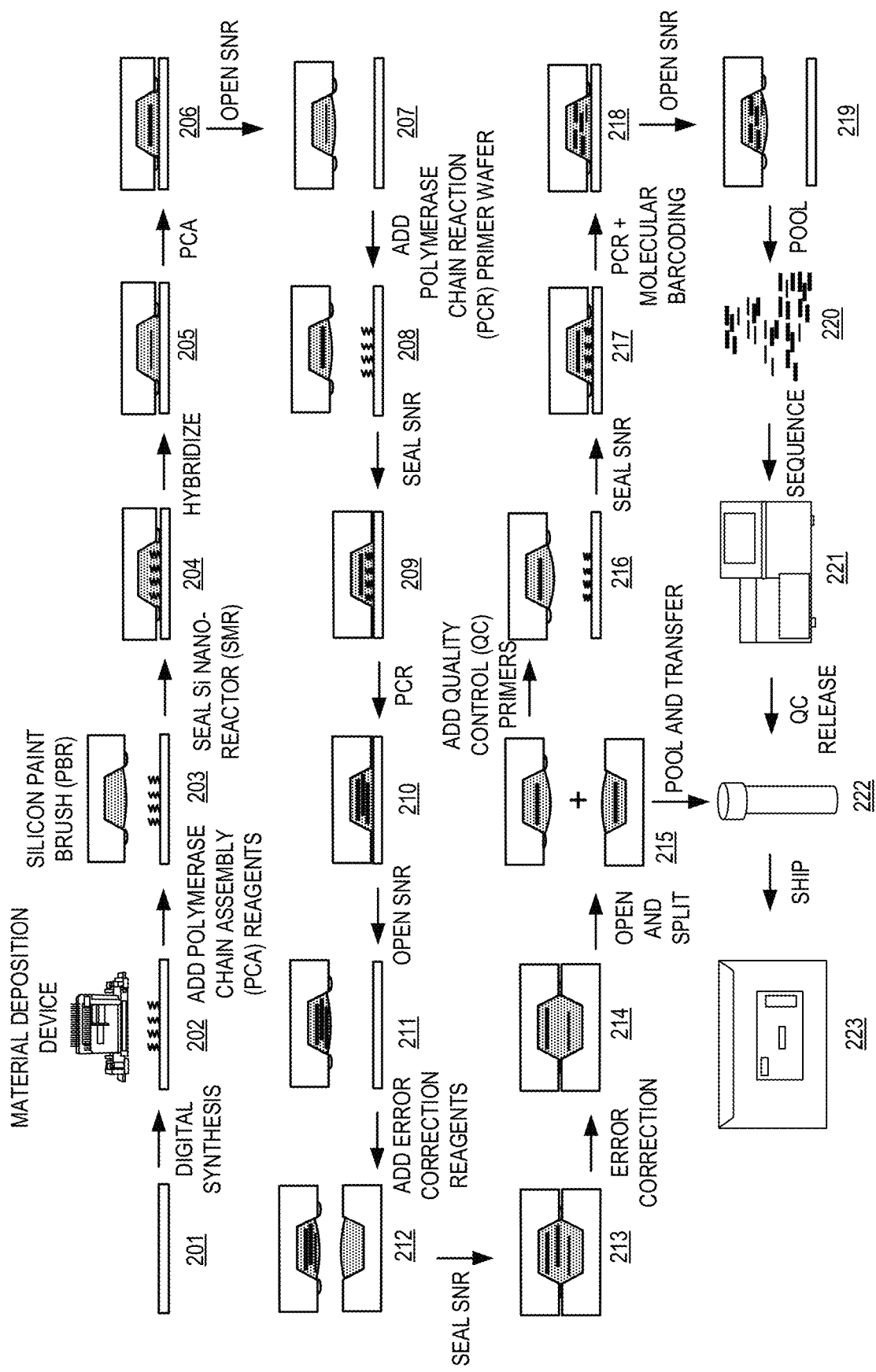
FIG. 2 presents a diagram of steps demonstrating an exemplary process workflow for gene synthesis as disclosed herein.

Referring to the Figures, FIG. 2 illustrates an exemplary process workflow for synthesis of nucleic acids (e.g., genes) from shorter nucleic acids. The workflow is divided generally into phases: (1) de novo synthesis of a single stranded nucleic acid library, (2) joining nucleic acids to form larger fragments, (3) error correction, (4) quality control, and (5) shipment. Prior to de novo synthesis, an intended nucleic acid sequence or group of nucleic acid sequences is preselected. For example, a group of genes is preselected for generation.

Once large nucleic acids for generation are selected, a predetermined library of nucleic acids is designed for de novo synthesis. Various suitable methods are known for generating high density polynucleotide arrays. In the workflow example, a device surface layer is provided. In the example, chemistry of the surface is altered in order to improve the polynucleotide synthesis process. Areas of low surface energy are generated to repel liquid while areas of high surface energy are generated to attract liquids. The surface itself may be in the form of a planar surface or contain variations in shape, such as protrusions or microwells which increase surface area. In the workflow example, high surface energy molecules selected serve a dual function of supporting DNA chemistry, as disclosed in International Patent Application Publication WO/2015/021080, which is herein incorporated by reference in its entirety.

In situ preparation of polynucleotide arrays is generated on a solid support and utilizes single nucleotide extension process to extend multiple oligomers in parallel. A deposition device, such as a material deposition device 201, is designed to release reagents in a step wise fashion such that multiple polynucleotides extend, in parallel, one residue at a time to generate oligomers with a predetermined nucleic acid sequence 202. In some instances, polynucleotides are cleaved from the surface at this stage. Cleavage includes gas cleavage, e.g., with ammonia or methylamine.

The generated polynucleotide libraries are placed in a reaction chamber. In this exemplary workflow, the reaction chamber (also referred to as "nanoreactor") is a silicon coated well, containing PCR reagents and lowered onto the polynucleotide library 203. Prior to or after the sealing 204 of the polynucleotides, a reagent is added to release the polynucleotides from the substrate. In the exemplary workflow, the polynucleotides are released subsequent to sealing of the nanoreactor 205. Once released, fragments of single stranded polynucleotides hybridize in order to span an entire long range sequence of DNA. Partial hybridization 205 is possible because each synthesized polynucleotide is designed to have a small portion overlapping with at least one other polynucleotide in the pool.

After hybridization, a PCA reaction is commenced. During the polymerase cycles, the polynucleotides anneal to complementary fragments and gaps are filled in by a polymerase. Each cycle increases the length of various fragments randomly depending on which polynucleotides find each other. Complementarity amongst the fragments allows for forming a complete large span of double stranded DNA 206.

After PCA is complete, the nanoreactor is separated from the device 207 and positioned for interaction with a device having primers for PCR 208. After sealing, the nanoreactor is subject to PCR 209 and the larger nucleic acids are amplified. After PCR 210, the nanochamber is opened 211, error correction reagents are added 212, the chamber is sealed 213 and an error correction reaction occurs to remove mismatched base pairs and/or strands with poor complementarity from the double stranded PCR amplification products 214. The nanoreactor is opened and separated 215. Error corrected product is next subject to additional processing steps, such as PCR and molecular bar coding, and then packaged 222 for shipment 223.

In some instances, quality control measures are taken. After error correction, quality control steps include for example interaction with a wafer having sequencing primers for amplification of the error corrected product 216, sealing the wafer to a chamber containing error corrected amplification product 217, and performing an additional round of amplification 218. The nanoreactor is opened 219 and the products are pooled 220 and sequenced 221. After an acceptable quality control determination is made, the packaged product 222 is approved for shipment 223.

In some instances, a nucleic acid generate by a workflow such as that in FIG. 2 is subject to mutagenesis using overlapping primers disclosed herein. In some instances, a library of primers are generated by in situ preparation on a solid support and utilize single nucleotide extension process to extend multiple oligomers in parallel. A deposition device, such as a material deposition device, is designed to release reagents in a step wise fashion such that multiple polynucleotides extend, in parallel, one residue at a time to generate oligomers with a predetermined nucleic acid sequence 202.

Computer Systems

Any of the systems described herein, may be operably linked to a computer and may be automated through a computer either locally or remotely. In various instances, the methods and systems of the disclosure may further comprise software programs on computer systems and use thereof. Accordingly, computerized control for the synchronization of the dispense/vacuum/refill functions such as orchestrating and synchronizing the material deposition device movement, dispense action and vacuum actuation are within the bounds of the disclosure. The computer systems may be programmed to interface between the user specified base sequence and the position of a material deposition device to deliver the correct reagents to specified regions of the substrate.

Figure 3:
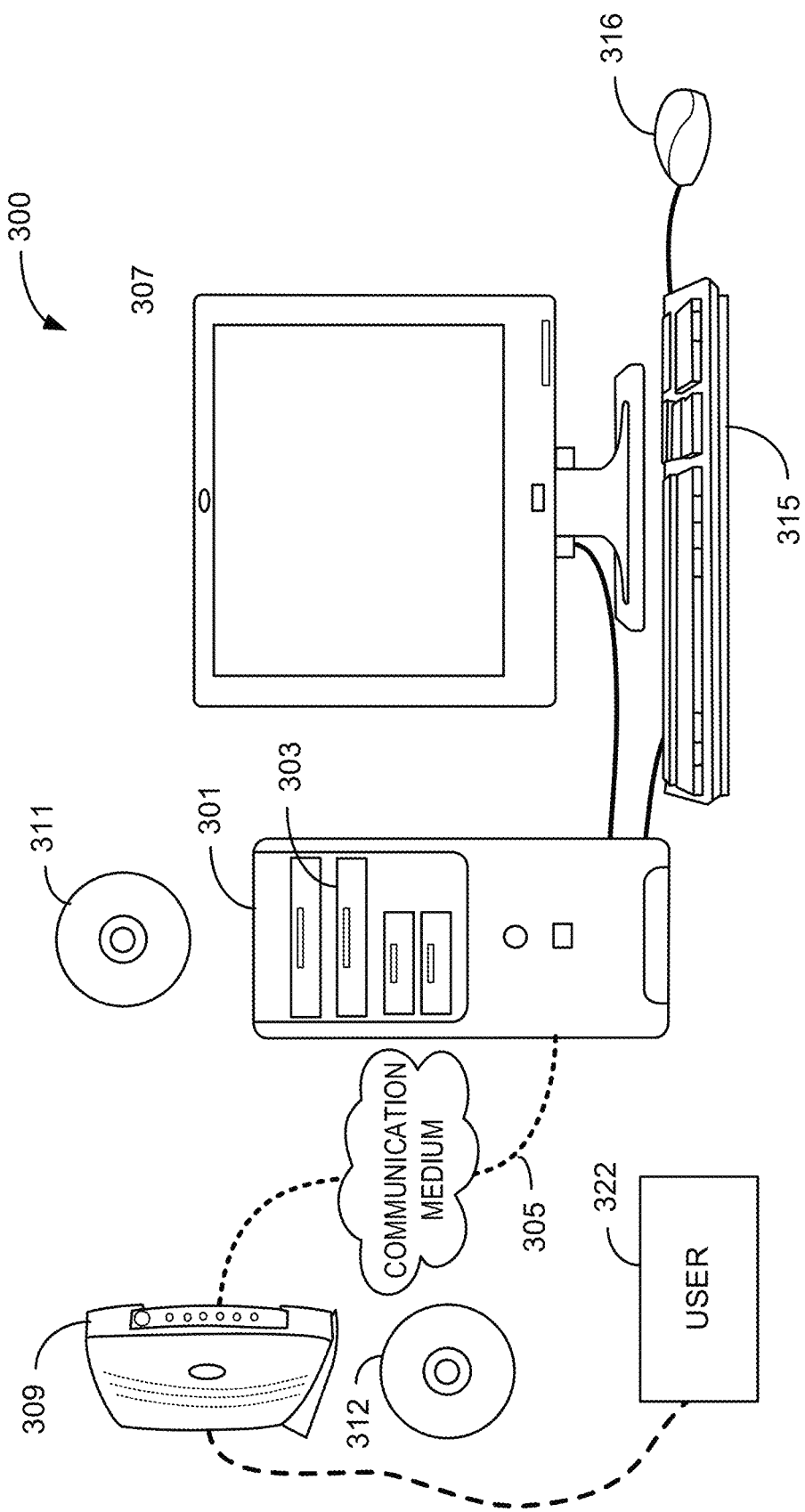
FIG. 3 illustrates an example of a computer system.

The computer system 300 illustrated in FIG. 3 may be understood as a logical apparatus that can read instructions from media 311 and/or a network port 305, which can optionally be connected to server 309 having fixed media 312. The system, such as shown in FIG. 3 can include a CPU 301, disk drives 303, optional input devices such as keyboard 315 and/or mouse 316 and optional monitor 307. Data communication can be achieved through the indicated communication medium to a server at a local or a remote location. The communication medium can include any means of transmitting and/or receiving data. For example, the communication medium can be a network connection, a wireless connection or an internet connection. Such a connection can provide for communication over the World Wide Web. It is envisioned that data relating to the present disclosure can be transmitted over such networks or connections for reception and/or review by a party 322 as illustrated in FIG. 3.

Figure 4:
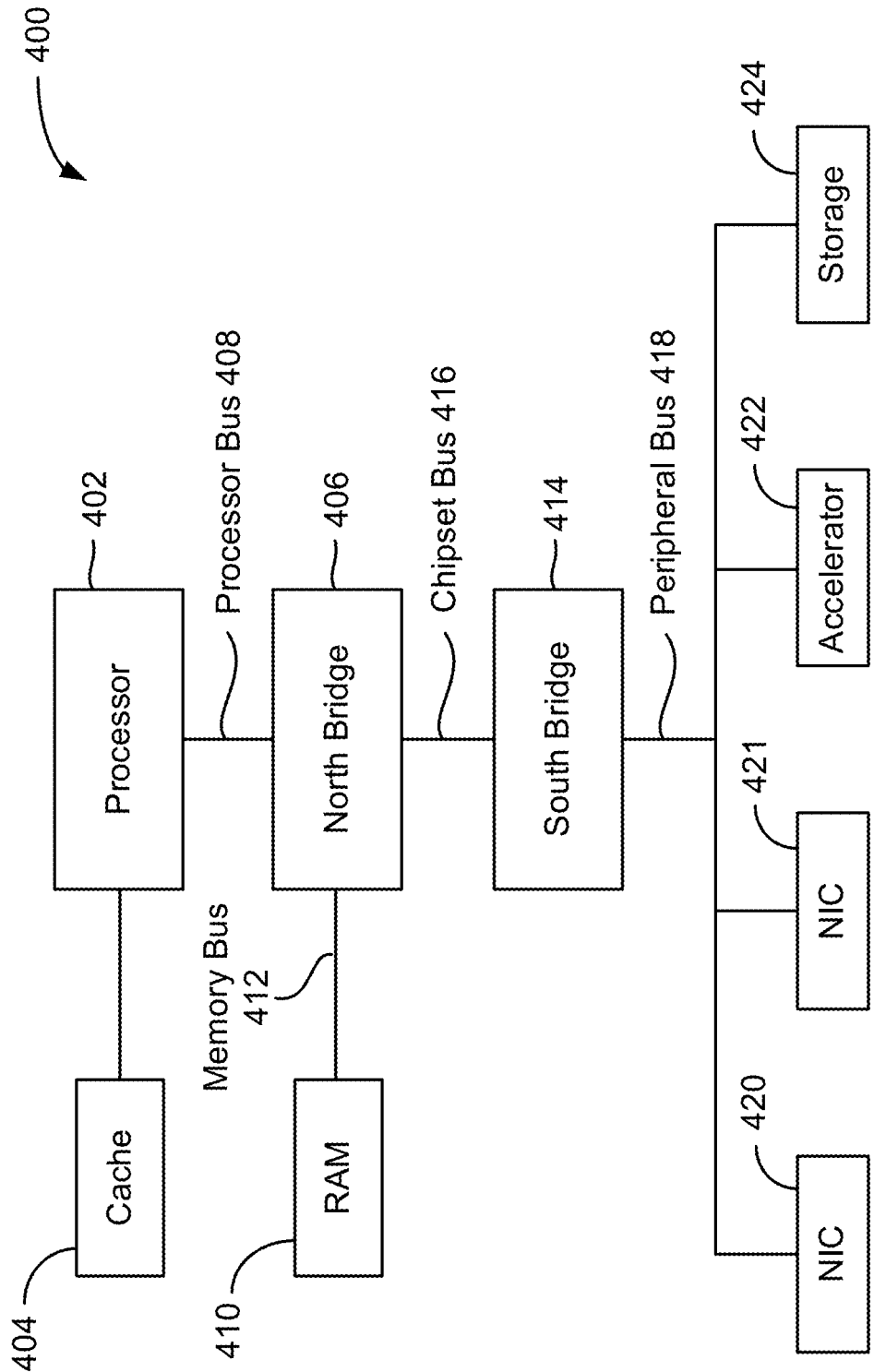
FIG. 4 is a block diagram illustrating an architecture of a computer system.

FIG. 4 is a block diagram illustrating a first example architecture of a computer system 400 that can be used in connection with example instances of the present disclosure. As depicted in FIG. 4, the example computer system can include a processor 402 for processing instructions. Non-limiting examples of processors include: Intel Xeon™ processor, AMD Opteron™ processor, Samsung 32-bit RISC ARM 1176JZ(F)—S v1.0™ processor, ARM Cortex-A8 Samsung S5PC100™ processor, ARM Cortex-A8 Apple A4™ processor, Marvell PXA 930™ processor, or a functionally-equivalent processor. Multiple threads of execution can be used for parallel processing. In some instances, multiple processors or processors with multiple cores can also be used, whether in a single computer system, in a cluster, or distributed across systems over a network comprising a plurality of computers, cell phones, and/or personal data assistant devices.

As illustrated in FIG. 4, a high speed cache 404 can be connected to, or incorporated in, the processor 402 to provide a high speed memory for instructions or data that have been recently, or are frequently, used by processor 402. The processor 402 is connected to a north bridge 406 by a processor bus 408. The north bridge 406 is connected to random access memory (RAM) 410 by a memory bus 412 and manages access to the RAM 410 by the processor 402. The north bridge 406 is also connected to a south bridge 414 by a chipset bus 416. The south bridge 414 is, in turn, connected to a peripheral bus 418. The peripheral bus can be, for example, PCI, PCI-X, PCI Express, or other peripheral bus. The north bridge and south bridge are often referred to as a processor chipset and manage data transfer between the processor, RAM, and peripheral components on the peripheral bus 418. In some alternative architectures, the functionality of the north bridge can be incorporated into the processor instead of using a separate north bridge chip. In some instances, system 400 can include an accelerator card 422 attached to the peripheral bus 418. The accelerator can include field programmable gate arrays (FPGAs) or other hardware for accelerating certain processing. For example, an accelerator can be used for adaptive data restructuring or to evaluate algebraic expressions used in extended set processing.

Software and data are stored in external storage 424 and can be loaded into RAM 410 and/or cache 404 for use by the processor. The system 400 includes an operating system for managing system resources; non-limiting examples of operating systems include: Linux, Windows™, MACOS™, BlackBerry OS™, iOS™, and other functionally equivalent operating systems, as well as application software running on top of the operating system for managing data storage and optimization in accordance with example instances of the present disclosure. In this example, system 400 also includes network interface cards (NICs) 420 and 421 connected to the peripheral bus for providing network interfaces to external storage, such as Network Attached Storage (NAS) and other computer systems that can be used for distributed parallel processing.

Figure 5:
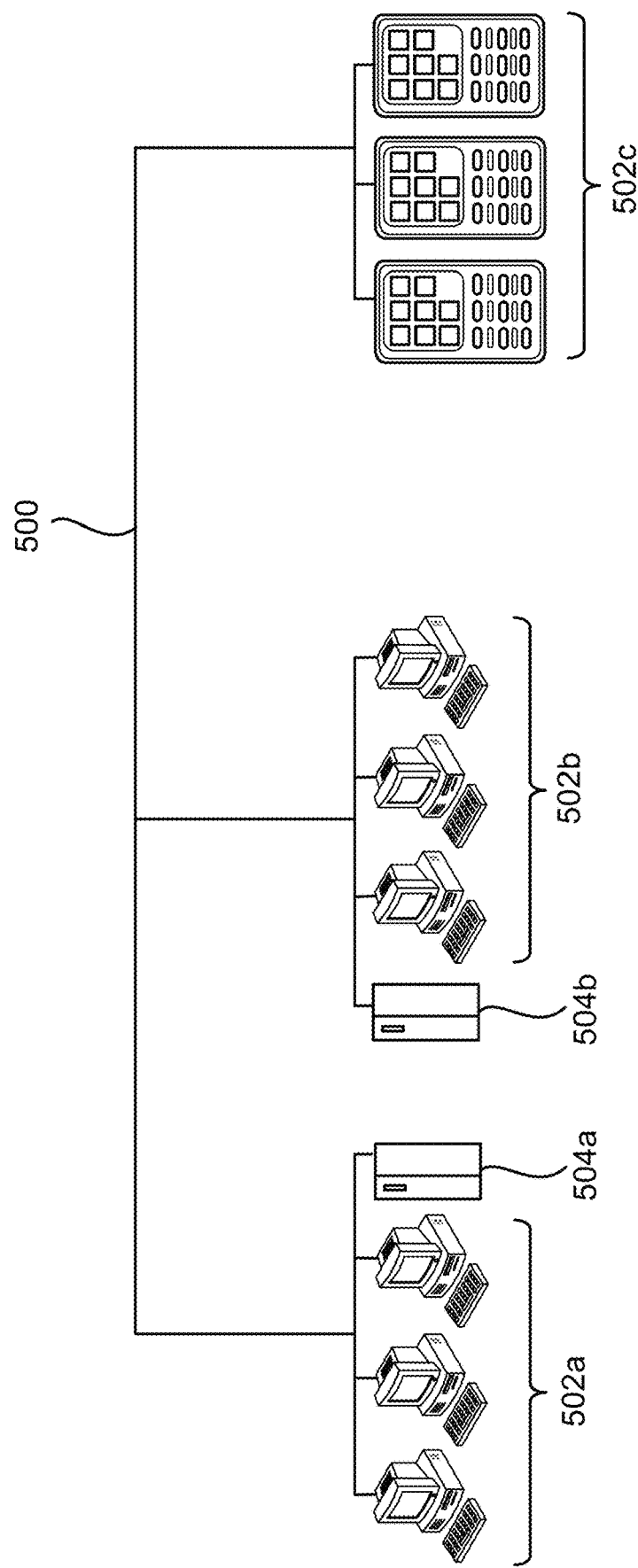
FIG. 5 is a diagram demonstrating a network configured to incorporate a plurality of computer systems, a plurality of cell phones and personal data assistants, and Network Attached Storage (NAS).

FIG. 5 is a diagram showing a network 500 with a plurality of computer systems 502a, and 502b, a plurality of cell phones and personal data assistants 502c, and Network Attached Storage (NAS) 504a, and 504b. In example instances, systems 502a, 502b, and 502c can manage data storage and optimize data access for data stored in Network Attached Storage (NAS) 504a and 504b. A mathematical model can be used for the data and be evaluated using distributed parallel processing across computer systems 502a, and 502b, and cell phone and personal data assistant systems 502c. Computer systems 502a, and 502b, and cell phone and personal data assistant systems 502c can also provide parallel processing for adaptive data restructuring of the data stored in Network Attached Storage (NAS) 504a and 504b. FIG. 5 illustrates an example only, and a wide variety of other computer architectures and systems can be used in conjunction with the various instances of the present disclosure. For example, a blade server can be used to provide parallel processing. Processor blades can be connected through a back plane to provide parallel processing. Storage can also be connected to the back plane or as Network Attached Storage (NAS) through a separate network interface. In some example instances, processors can maintain separate memory spaces and transmit data through network interfaces, back plane or other connectors for parallel processing by other processors. In other instances, some or all of the processors can use a shared virtual address memory space.

Figure 6:
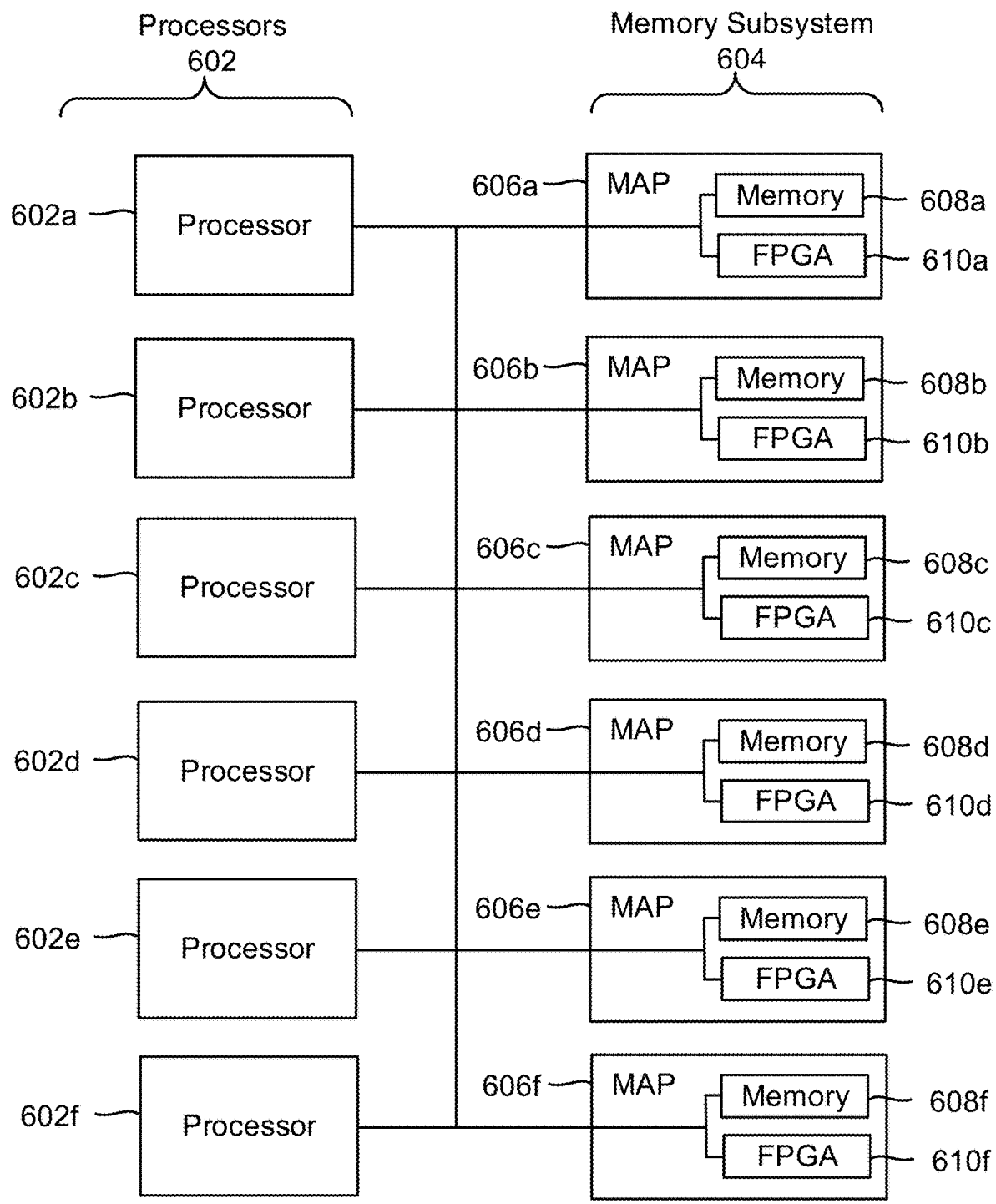
FIG. 6 is a block diagram of a multiprocessor computer system using a shared virtual address memory space.

FIG. 6 is a block diagram of a multiprocessor computer system using a shared virtual address memory space in accordance with an example instance. The system includes a plurality of processors 602a-f that can access a shared memory subsystem 604. The system incorporates a plurality of programmable hardware memory algorithm processors (MAPs) 606a-f in the memory subsystem 604. Each MAP 606a-f can comprise a memory 608a-f and one or more field programmable gate arrays (FPGAs) 610a-f. The MAP provides a configurable functional unit and particular algorithms, or portions of algorithms can be provided to the FPGAs 610a-f for processing in close coordination with a respective processor. For example, the MAPs can be used to evaluate algebraic expressions regarding the data model and to perform adaptive data restructuring in example instances. In this example, each MAP is globally accessible by all of the processors for these purposes. In one configuration, each MAP can use Direct Memory Access (DMA) to access an associated memory 608a-f, allowing it to execute tasks independently of, and asynchronously from the respective microprocessor 602a-f In this configuration, a MAP can feed results directly to another MAP for pipelining and parallel execution of algorithms.

The above computer architectures and systems are examples only, and a wide variety of other computer, cell phone, and personal data assistant architectures and systems can be used in connection with example instances, including systems using any combination of general processors, co-processors, FPGAs and other programmable logic devices, system on chips (SOCs), application specific integrated circuits (ASICs), and other processing and logic elements. In some instances, all or part of the computer system can be implemented in software or hardware. Any variety of data storage media can be used in connection with example instances, including random access memory, hard drives, flash memory, tape drives, disk arrays, Network Attached Storage (NAS) and other local or distributed data storage devices and systems.

In example instances, the computer system can be implemented using software modules executing on any of the above or other computer architectures and systems. In other instances, the functions of the system can be implemented partially or completely in firmware, programmable logic devices such as field programmable gate arrays (FPGAs) as referenced in FIG. 4, system on chips (SOCs), application specific integrated circuits (ASICs), or other processing and logic elements. For example, the Set Processor and Optimizer can be implemented with hardware acceleration through the use of a hardware accelerator card, such as accelerator card 422 illustrated in FIG. 4.

The following examples are set forth to illustrate more clearly the principle and practice of embodiments disclosed herein to those skilled in the art and are not to be construed as limiting the scope of any claimed embodiments. Unless otherwise stated, all parts and percentages are on a weight basis.

EXAMPLES

The following examples are given for the purpose of illustrating various embodiments of the disclosure and are not meant to limit the present disclosure in any fashion. The present examples, along with the methods described herein are presently representative of preferred embodiments, are exemplary, and are not intended as limitations on the scope of the disclosure. Changes therein and other uses which are encompassed within the spirit of the disclosure as defined by the scope of the claims will occur to those skilled in the art.

Example 1: Functionalization of a Device Surface

A device was functionalized to support the attachment and synthesis of a library of polynucleotides. The device surface was first wet cleaned using a piranha solution comprising 90% $H_2SO_4$ and 10% $H_2O_2$ for 20 minutes. The device was rinsed in several beakers with DI water, held under a DI water gooseneck faucet for 5 min, and dried with N2. The device was subsequently soaked in $NH_4OH$ (1:100; 3 mL:300 mL) for 5 min, rinsed with DI water using a handgun, soaked in three successive beakers with DI water for 1 min each, and then rinsed again with DI water using the handgun. The device was then plasma cleaned by exposing the device surface to $O_2$. A SAMCO PC-300 instrument was used to plasma etch $O_2$ at 250 watts for 1 min in downstream mode.

The cleaned device surface was actively functionalized with a solution comprising N-(3-triethoxysilylpropyl)-4-hydroxybutyramide using a YES-1224P vapor deposition oven system with the following parameters: 0.5 to 1 torr, 60 min, 70° C., 135° C. vaporizer. The device surface was resist coated using a Brewer Science 200× spin coater. SPR™ 3612 photoresist was spin coated on the device at 2500 rpm for 40 sec. The device was pre-baked for 30 min at 90° C. on a Brewer hot plate. The device was subjected to photo-lithography using a Karl Suss MA6 mask aligner instrument. The device was exposed for 2.2 sec and developed for 1 min in MSF 26A. Remaining developer was rinsed with the handgun and the device soaked in water for 5 min. The device was baked for 30 min at 100° C. in the oven, followed by visual inspection for lithography defects using a Nikon L200. A descum process was used to remove residual resist using the SAMCO PC-300 instrument to $O_2$ plasma etch at 250 watts for 1 min.

The device surface was passively functionalized with a 100 µL solution of perfluorooctyltrichlorosilane mixed with 10 µL light mineral oil. The device was placed in a chamber, pumped for 10 min, and then the valve was closed to the pump and left to stand for 10 min. The chamber was vented to air. The device was resist stripped by performing two soaks for 5 min in 500 mL NMP at 70° C. with ultrasonication at maximum power (9 on Crest system). The device was then soaked for 5 min in 500 mL isopropanol at room temperature with ultrasonication at maximum power. The device was dipped in 300 mL of 200 proof ethanol and blown dry with N2. The functionalized surface was activated to serve as a support for polynucleotide synthesis.

Example 2: Synthesis of a 50-Mer Sequence on an Oligonucleotide Synthesis Device A two-dimensional oligonucleotide synthesis device was assembled into a flowcell, which was connected to a flowcell (Applied Biosystems (ABI394 DNA Synthesizer"). The two-dimensional oligonucleotide synthesis device was uniformly functionalized with N-(3-TRIETHOXYSILYLPROPYL)-4-HYDROXYBUTYRAMIDE (Gelest) was used to synthesize an exemplary polynucleotide of 50 bp ("50-mer polynucleotide") using polynucleotide synthesis methods described herein.

The sequence of the 50-mer was as described. 5'AGACAATCAACCAT-TTGGGGTGGACAGCCTTGACCTCTAGACTTCGG-CAT ##TTTTT TTTTT3' (SEQ ID NO: 2673), where # denotes Thymidine-succinyl hexaamide CED phosphoramidite (CLP-2244 from ChemGenes), which is a cleavable linker enabling the release of oligos from the surface during deprotection.

The synthesis was done using standard DNA synthesis chemistry (coupling, capping, oxidation, and deblocking) according to the protocol in Table 2 and an ABI synthesizer.

TABLE 2

Synthesis protocols

General DNA Synthesis — Table 2

| Process Name | Process Step | Time (sec) |
|---|---|---|
| WASH (Acetonitrile Wash Flow) | Acetonitrile System Flush | 4 |
| | Acetonitrile to Flowcell | 23 |
| | N2 System Flush | 4 |
| | Acetonitrile System Flush | 4 |
| DNA BASE ADDITION (Phosphoramidite + Activator Flow) | Activator Manifold Flush | 2 |
| | Activator to Flowcell | 6 |
| | Activator + Phosphoramidite to Flowcell | 6 |
| | Activator to Flowcell | 0.5 |
| | Activator + Phosphoramidite to Flowcell | 5 |
| | Activator to Flowcell | 0.5 |
| | Activator + Phosphoramidite to Flowcell | 5 |
| | Activator to Flowcell | 0.5 |
| | Activator + Phosphoramidite to Flowcell | 5 |
| | Incubate for 25sec | 25 |
| WASH (Acetonitrile Wash Flow) | Acetonitrile System Flush | 4 |
| | Acetonitrile to Flowcell | 15 |
| | N2 System Flush | 4 |
| | Acetonitrile System Flush | 4 |
| DNA BASE ADDITION (Phosphoramidite + Activator Flow) | Activator Manifold Flush | 2 |
| | Activator to Flowcell | 5 |
| | Activator + Phosphoramidite to Flowcell | 18 |
| | Incubate for 25sec | 25 |
| WASH (Acetonitrile Wash Flow) | Acetonitrile System Flush | 4 |
| | Acetonitrile to Flowcell | 15 |
| | N2 System Flush | 4 |
| | Acetonitrile System Flush | 4 |
| CAPPING (CapA + B, 1:1, Flow) | CapA+B to Flowcell | 15 |
| WASH (Acetonitrile Wash Flow) | Acetonitrile System Flush | 4 |
| | Acetonitrile to Flowcell | 15 |
| | Acetonitrile System Flush | 4 |
| OXIDATION (Oxidizer Flow) | Oxidizer to Flowcell | 18 |
| WASH (Acetonitrile Wash Flow) | Acetonitrile System Flush | 4 |
| | N2 System Flush | 4 |
| | Acetonitrile System Flush | 4 |
| | Acetonitrile to Flowcell | 15 |
| | Acetonitrile System Flush | 4 |
| | Acetonitrile to Flowcell | 15 |
| | N2 System Flush | 4 |
| | Acetonitrile System Flush | 4 |
| | Acetonitrile to Flowcell | 23 |
| | N2 System Flush | 4 |
| | Acetonitrile System Flush | 4 |

TABLE 2-continued

Synthesis protocols

| General DNA Synthesis | Table 2 | |
|---|---|---|
| Process Name | Process Step | Time (sec) |
| DEBLOCKING (Deblock Flow) | Deblock to Flowcell | 36 |
| WASH (Acetonitrile Wash Flow) | Acetonitrile System Flush | 4 |
| | N2 System Flush | 4 |
| | Acetonitrile System Flush | 4 |
| | Acetonitrile to Flowcell | 18 |
| | N2 System Flush | 4.13 |
| | Acetonitrile System Flush | 4.13 |
| | Acetonitrile to Flowcell | 15 |

The phosphoramidite/activator combination was delivered similar to the delivery of bulk reagents through the flowcell. No drying steps were performed as the environment stays "wet" with reagent the entire time.

The flow restrictor was removed from the ABI 394 synthesizer to enable faster flow. Without flow restrictor, flow rates for amidites (0.1 M in ACN), Activator, (0.25 M Benzoylthiotetrazole ("BTT"; 30-3070-xx from GlenResearch) in ACN), and Ox (0.02 M I2 in 20% pyridine, 10% water, and 70% THF) were roughly ~100 uL/sec, for acetonitrile ("ACN") and capping reagents (1:1 mix of CapA and CapB, wherein CapA is acetic anhydride in THF/Pyridine and CapB is 16% 1-methylimidazole in THF), roughly ~200 uL/sec, and for Deblock (3% dichloroacetic acid in toluene), roughly ~300 uL/sec (compared to ~50 uL/sec for all reagents with flow restrictor). The time to completely push out Oxidizer was observed, the timing for chemical flow times was adjusted accordingly and an extra ACN wash was introduced between different chemicals. After polynucleotide synthesis, the chip was deprotected in gaseous ammonia overnight at 75 psi. Five drops of water were applied to the surface to recover polynucleotides. The recovered polynucleotides were then analyzed on a BioAnalyzer small RNA chip.

Example 3: Synthesis of a 100-Mer Sequence on an Oligonucleotide Synthesis Device The same process as described in Example 2 for the synthesis of the 50-mer sequence was used for the synthesis of a 100-mer polynucleotide ("100-mer polynucleotide"; 5' CGGGATCCTTATCGTCATCGTCGTACA-GATCCCGACCCATTTGCTGTCCACCAGTCA TGCTAGCCATACCATGATGATGATGATGAT-GAGAACCCCGCAT ##TTTTTTTTTT3' (SEQ ID NO: 2674), where # denotes Thymidine-succinyl hexaamide CED phosphoramidite (CLP-2244 from ChemGenes) on two different silicon chips, the first one uniformly functionalized with N-(3-TRIETHOXYSILYLPROPYL)-4-HY-DROXYBUTYRAMIDE and the second one functionalized with 5/95 mix of 11-acetoxyundecyltriethoxysilane and n-decyltriethoxysilane, and the polynucleotides extracted from the surface were analyzed on a BioAnalyzer instrument.

All ten samples from the two chips were further PCR amplified using a forward (5'ATGCGGGGTTCTCAT-CATC3' (SEQ ID NO: 2675)) and a reverse (5'CGG-GATCCTTATCGTCATCG3' (SEQ ID NO: 2676)) primer in a 50 uL PCR mix (25 uL NEB Q5 mastermix, 2.5 uL 10 uM Forward primer, 2.5 uL 10 uM Reverse primer, 1 uL polynucleotide extracted from the surface, and water up to 50 uL) using the following thermalcycling program:

98° C., 30 sec

98° C., 10 sec; 63° C., 10 sec; 72° C., 10 sec; repeat 12 cycles

72° C., 2 min

The PCR products were also run on a BioAnalyzer, demonstrating sharp peaks at the 100-mer position. Next, the PCR amplified samples were cloned, and Sanger sequenced. Table 3 summarizes the results from the Sanger sequencing for samples taken from spots 1-5 from chip 1 and for samples taken from spots 6-10 from chip 2.

TABLE 3

Sequencing results

| Spot | Error rate | Cycle efficiency |
|---|---|---|
| 1 | 1/763 bp | 99.87% |
| 2 | 1/824 bp | 99.88% |
| 3 | 1/780 bp | 99.87% |
| 4 | 1/429 bp | 99.77% |
| 5 | 1/1525 bp | 99.93% |
| 6 | 1/1615 bp | 99.94% |
| 7 | 1/531 bp | 99.81% |
| 8 | 1/1769 bp | 99.94% |
| 9 | 1/854 bp | 99.88% |
| 10 | 1/1451 bp | 99.93% |

Thus, the high quality and uniformity of the synthesized polynucleotides were repeated on two chips with different surface chemistries. Overall, 89% of the 100-mers that were sequenced were perfect sequences with no errors, corresponding to 233 out of 262.

Table 4 summarizes error characteristics for the sequences obtained from the polynucleotides samples from spots 1-10.

TABLE 4

| Error characteristics | | | | | | | | | | |
|---|---|---|---|---|---|---|---|---|---|---|
| Sample ID/Spot no. | OSA_0 046/1 | OSA_0 047/2 | OSA_0 048/3 | OSA_0 049/4 | OSA_0 050/5 | OSA_0 051/6 | OSA_0 052/7 | OSA_0 053/8 | OSA_0 054/9 | OSA_0 055/10 |
| Total Sequences | 32 | 32 | 32 | 32 | 32 | 32 | 32 | 32 | 32 | 32 |
| Sequencing Quality | 25 of 28 | 27 of 27 | 26 of 30 | 21 of 23 | 25 of 26 | 29 of 30 | 27 of 31 | 29 of 31 | 28 of 29 | 25 of 28 |
| Oligo Quality | 23 of 25 | 25 of 27 | 22 of 26 | 18 of 21 | 24 of 25 | 25 of 29 | 22 of 27 | 28 of 29 | 26 of 28 | 20 of 25 |
| ROI Match Count | 2500 | 2698 | 2561 | 2122 | 2499 | 2666 | 2625 | 2899 | 2798 | 2348 |

TABLE 4-continued

| | Error characteristics | | | | | | | | | |
|---|---|---|---|---|---|---|---|---|---|---|
| ROI Mutation | 2 | 2 | 1 | 3 | 1 | 0 | 2 | 1 | 2 | 1 |
| ROI Multi Base Deletion | 0 | 0 | 0 | 0 | 0 | 0 | 0 | 0 | 0 | 0 |
| ROI Small Insertion | 1 | 0 | 0 | 0 | 0 | 0 | 0 | 0 | 0 | 0 |
| ROI Single Base Deletion | 0 | 0 | 0 | 0 | 0 | 0 | 0 | 0 | 0 | 0 |
| Large Deletion Count | 0 | 0 | 1 | 0 | 0 | 1 | 1 | 0 | 0 | 0 |
| Mutation: G > A | 2 | 2 | 1 | 2 | 1 | 0 | 2 | 1 | 2 | 1 |
| Mutation: T > C | 0 | 0 | 0 | 1 | 0 | 0 | 0 | 0 | 0 | 0 |
| ROI Error Count | 3 | 2 | 2 | 3 | 1 | 1 | 3 | 1 | 2 | 1 |
| ROI Error Rate | Err: ~1 in 834 | Err: ~1 in 1350 | Err: ~1 in 1282 | Err: ~1 in 708 | Err: ~1 in 2500 | Err: ~1 in 2667 | Err: ~1 in 876 | Err: ~1 in 2900 | Err: ~1 in 1400 | Err: ~1 in 2349 |
| ROI Minus Primer Error Rate | MP Err: ~1 in 763 | MP Err: ~1 in 824 | MP Err: ~1 in 780 | MP Err: ~1 in 429 | MP Err: ~1 in 1525 | MP Err: ~1 in 1615 | MP Err: ~1 in 531 | MP Err: ~1 in 1769 | MP Err: ~1 in 854 | MP Err: ~1 in 1451 |

Example 4: Panning and Screening for Identification of Antibodies for SARS-CoV-2 and ACE2

This example describes identification of antibodies for SARS-CoV-2 and ACE2.

Design, Construction, and Screening of Anti-S1 Antibody Phage Libraries

Four phage antibody libraries were generated for screening against the SARS-CoV-2 S1 (GenBank QHD43416.1, residues 16-685). The CDR diversity of the libraries based on the repertoires from human and/or llama CDR sequences as described below, which were subsequently synthesized and assembled into antibody hypervariable regions for phage display were maximized. The four such libraries included the following:
  (1) a short-chain variable fragment (scFv) library constructed using CDRs identified in the memory B cells of a convalescent COVID-19 donor ("COVID-19 scFv", Antibody 1)
  (2) an antigen-binding fragment (Fab) library constructed using CDRs from human naïve and memory B cells ("Hyperimmune Fab", Antibody 2)
  (3) a humanized llama nanobody library with shuffled, llama-based CDR diversity ("VHH hShuffle", Antibody 5)
  (4) a humanized llama nanobody library constructed using natural llama CDR1/2 sequences and human CDR3s identified from human naïve and memory B cells ("VHH Hyperimmune", Antibody 6)

The antibodies are listed in Example 11 in Tables 8-30. Each library possessed a CDR diversity of $>10^{10}$. Antibodies were selected for SARS-CoV-2 S1 binding using a bead-based biopanning strategy. For each library, phages were selected over four rounds of panning to identify putative high-affinity S1-binding antibodies. After panning, enzyme-linked immunosorbent assay (ELISA) was employed to assess the binding of phage-displayed antibodies to S1 protein. Antibody candidates from each library that elicited a greater than 10-fold enrichment over a bovine serum albumin control protein were selected as initial leads. From the COVID-19 scFv (Antibody 1), Hyperimmune Fab (Antibody 2), VHH hShuffle (Antibody 5), VHH Hyperimmune (Antibody 6) libraries, 41, 14, 68, and 112 unique clones, respectively were identified.

Following phage display ELISA screening, S1-binding antibody candidates were reformatted to human IgG1 (COVID-19 scFv, Hyperimmune Fab) or a VHH-Fc fusion containing the Fc region of human IgG1 (VHH hShuffle, VHH Hyperimmune hShuffle) for further characterization and development.

Biophysical Characterization and Competition Binning of Antibody Candidates

The phage display workflow identified 235 S1-binding leads across the four phage libraries that were screened. Given the diverse sources of CDR repertoires that were used to design these libraries, the sequence diversity of the hypervariable region by Sanger DNA sequencing was identified for each candidate and aligning the resulting hypervariable sequences across candidates from all four libraries. Antibody candidates from libraries containing overlapping CDR diversity were more closely related than those that drew from entirely distinct CDR sources. For example, many Antibody 5 and Antibody 6 candidates—both of which contained natural llama CDR1/2s—were interspersed in closely related sequence families.

The binding affinity and specificity of the S1 antibody candidates using surface plasmon resonance (SPR) and S1 RBD-ACE2 competition assays, respectively were determined. Multiple S1 antibody candidates with nanomolar affinities against SARS-CoV-2 S1, including 1-35 ($K_D$=83 nM), 2-2 ($K_D$=21 nM), 2-6 ($K_D$=25 nM), 5-1 ($K_D$=6.6 nM), 6-3 ($K_D$=32 nM), and 6-63 ($K_D$=46 nM) were identified. Additionally, all but one of these candidates bound to the prefusion-stabilized SARS-CoV-2 S trimer with picomolar affinities (data not shown). The cross-binding of antibody candidates to the S1 domain of SARS-CoV S protein was also assayed. All antibody candidates specifically bound SARS-CoV-2 S1 except for 2-5 and 2-2, which both cross-bound with SARS-CoV spike protein. The binding of S1 antibody candidates to ACE2 in an ELISA and flow cytometric competition binding assays were also determined. For the flow cytometry assay, each mAb candidate was incubated with recombinant SARS-CoV-2 S1 RBD and Vero E6 cells, which are susceptible to SARS-CoV and SARS-CoV-2 infection via ACE2. Many high-affinity anti-S1 mAbs effectively blocked the interaction between SARS-CoV-2 S1 RBD and ACE2 on Vero E6 cells as measured by flow cytometry, including 2-5, 2-2, 5-1, and 6-63. Nonetheless, some high-affinity, S1-binding candidates such as 6-42 and 1-12 failed to block this interaction. Notably, 1-12 did compete with ACE2 in the less physiologically relevant ELISA assay.

The cross-competition of the S1 antibody candidates and existing SARS-CoV-2 antibodies, including CR3022 and SAD-S35 (Acro Biosystems), with S1 using high-throughput surface plasmon resonance (HT-SPR) were investigated. This assay revealed four competition bins: namely, two bins that overlapped serially, and two additional, independent bins. The first bin (bin 1) included numerous VHH (Antibody 5) candidates and SAD-535. CR3022 competed with a few Antibody 2 candidates in bin 2. 2-2 bridged bins 1 and 2, forming a bin with CR3022 and SAD-535. The remaining bins, 3 and 4, exhibited no overlap. Bin 3 included 2-6, 1-35, 1-16, and 1-32. Bin 4 only contained 6-24, suggesting that it binds a unique epitope not targeted by the other candidates. The bins identified here may not reflect epitope bins per se, as other factors such as steric hindrance can allow antibodies with distinct epitopes to compete with one another for S1 binding.

Example 5. Epitope Mapping

Having identified several neutralizing mAbs, their binding epitopes were investigated.

Figure 7A:
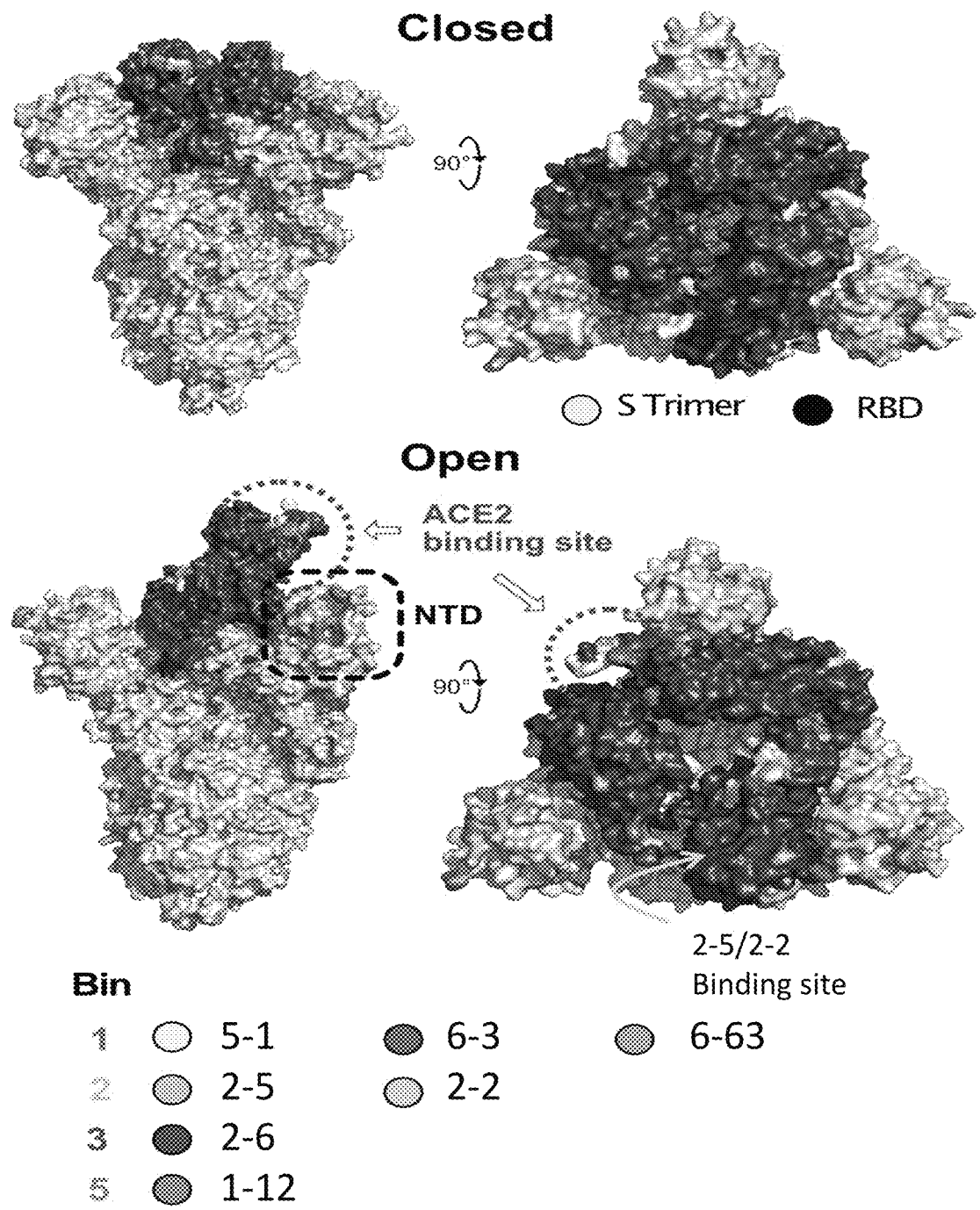
FIGS. 7A-7C illustrate epitope mapping of SARS-CoV-2 S1-binding antibodies.
Figure 7B:
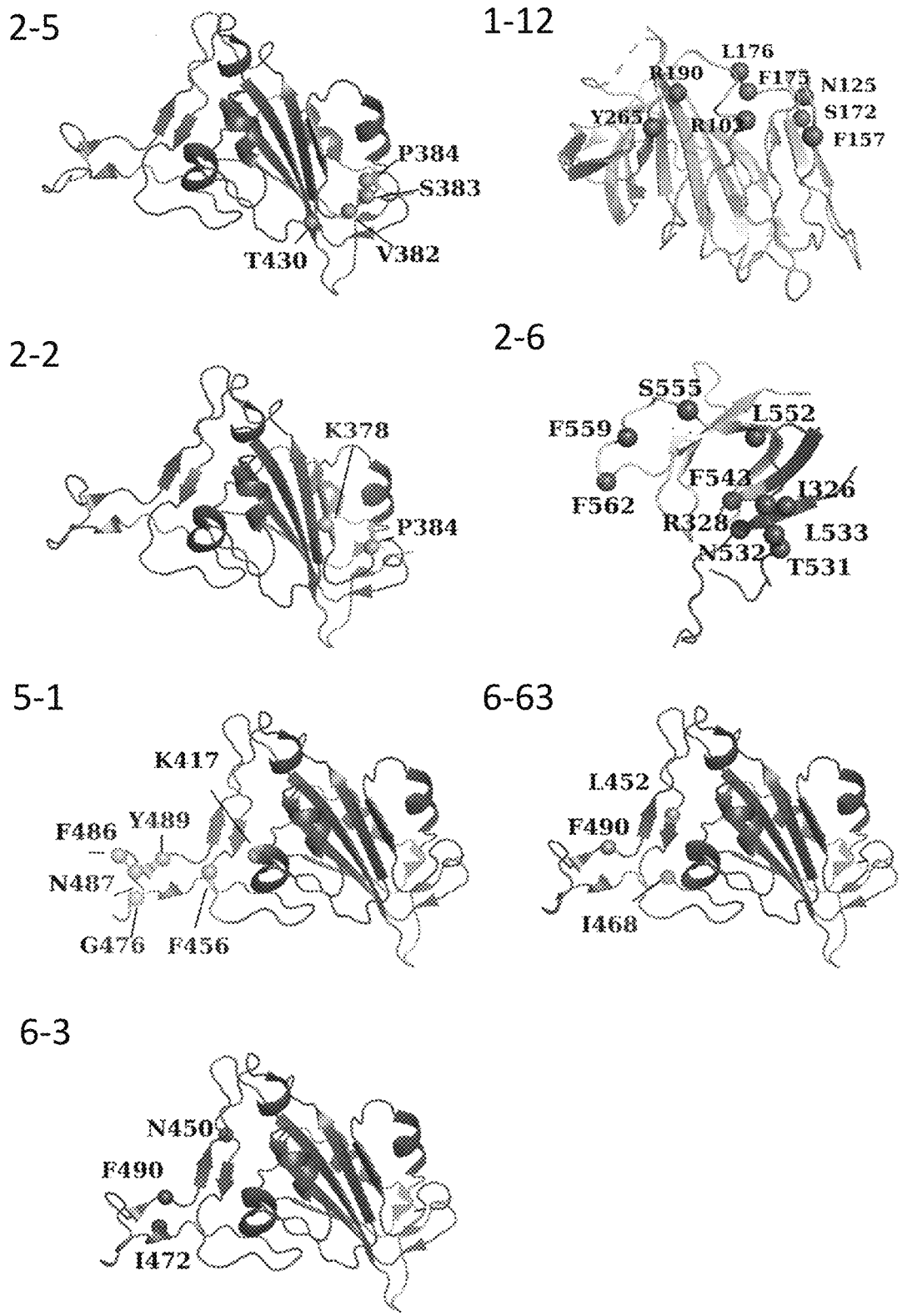
Figure 7C:
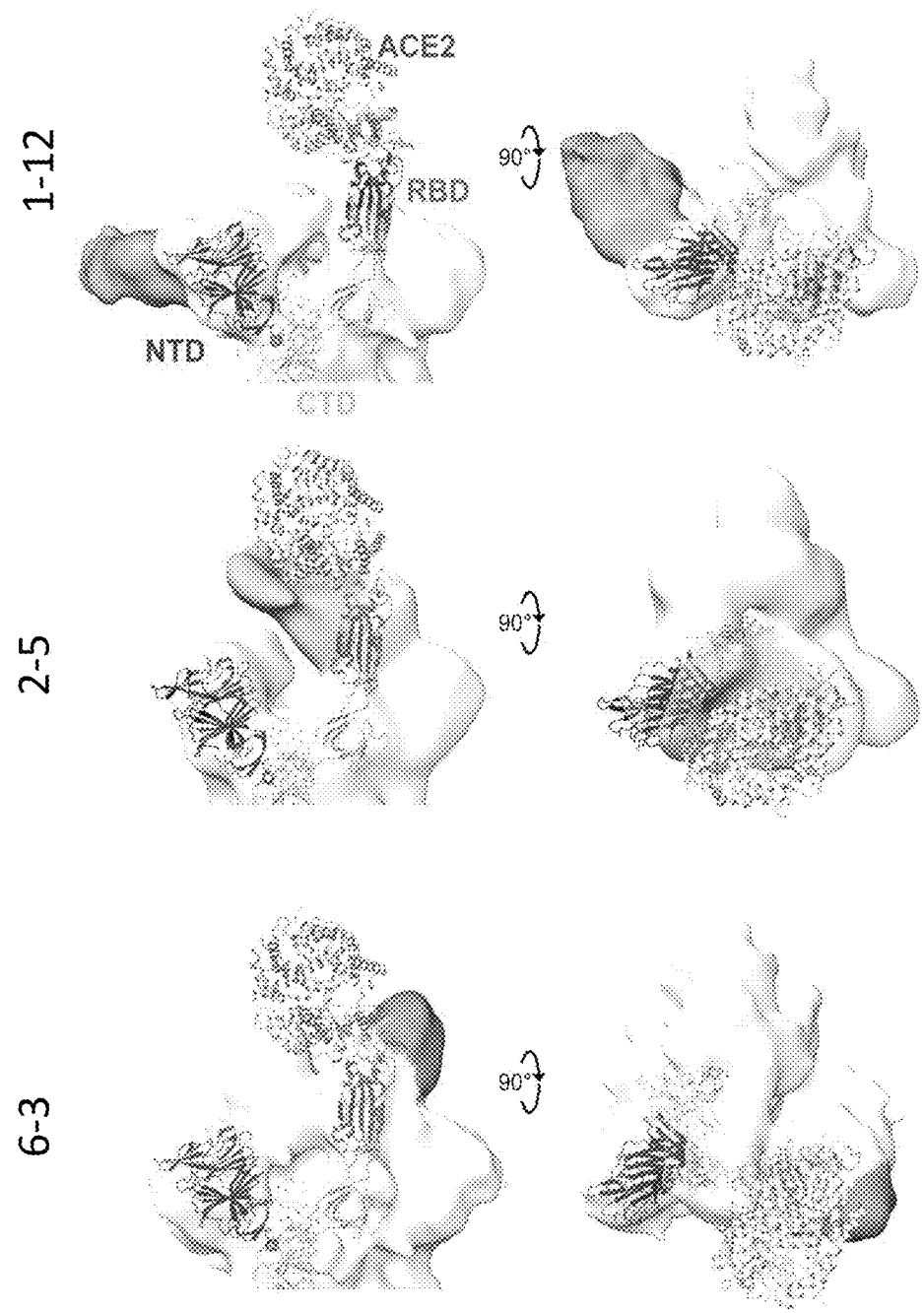
Figure 11A:
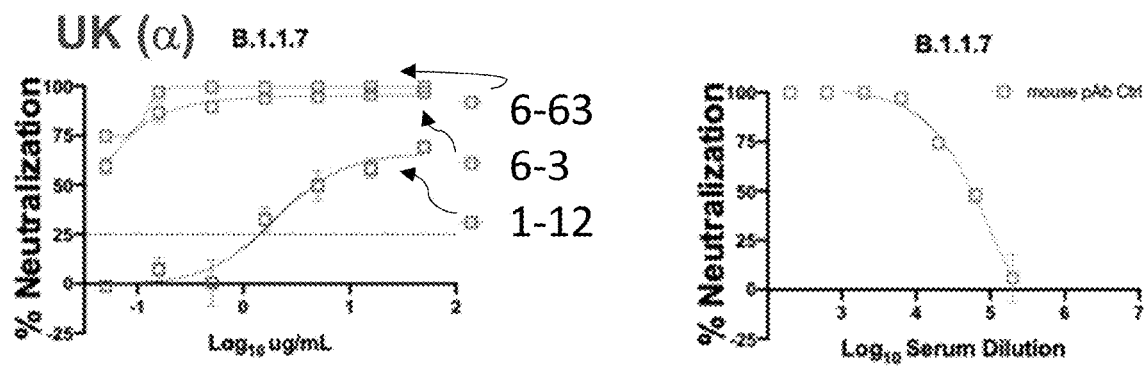
Figure 11B:
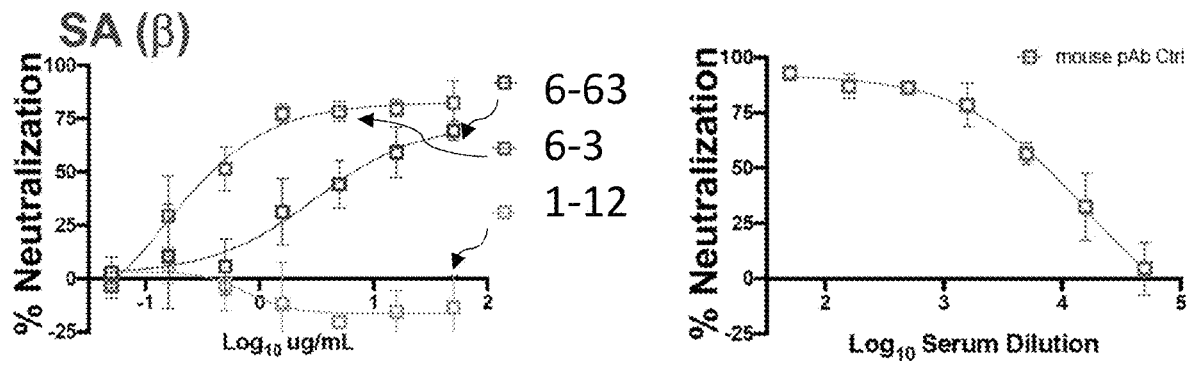
Figure 11C:
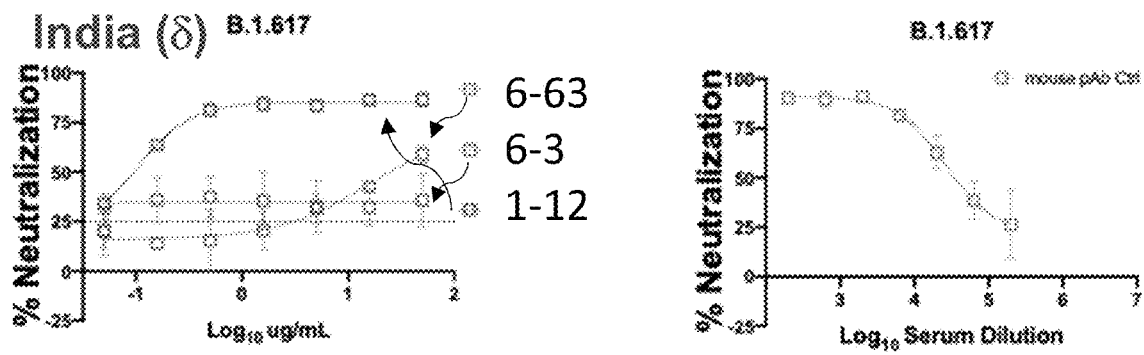
Figure 12A:
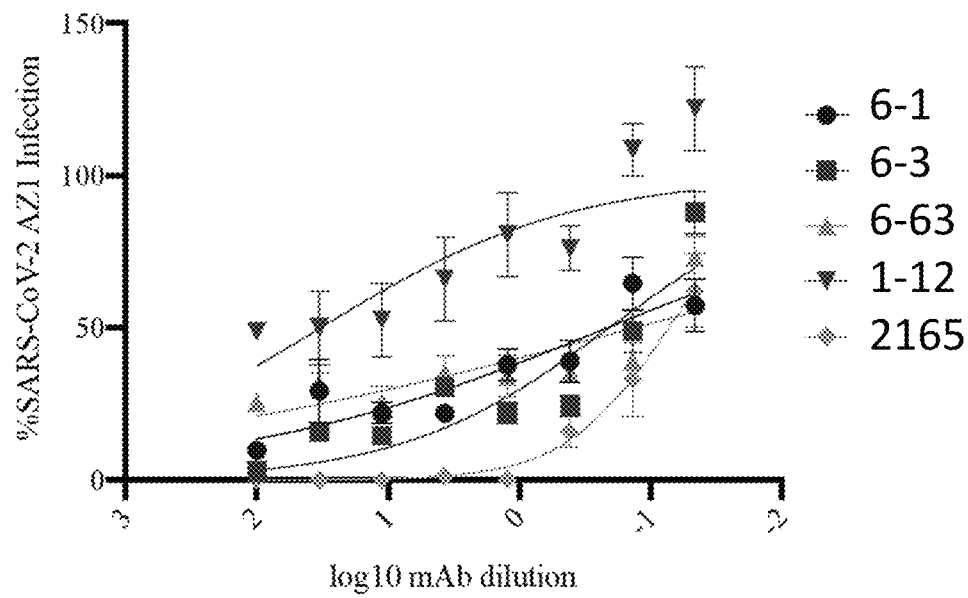
FIGS. 12A-12D illustrate neutralization data of SARS-CoV-2 variants AZ1 (FIG. 12A) and B.1.351 (FIG. 12B). Replicates of the neutralization experiments for AZ1 (FIG. 12C), and B.1.351 (FIG. 12D) are also shown.
Figure 12B:
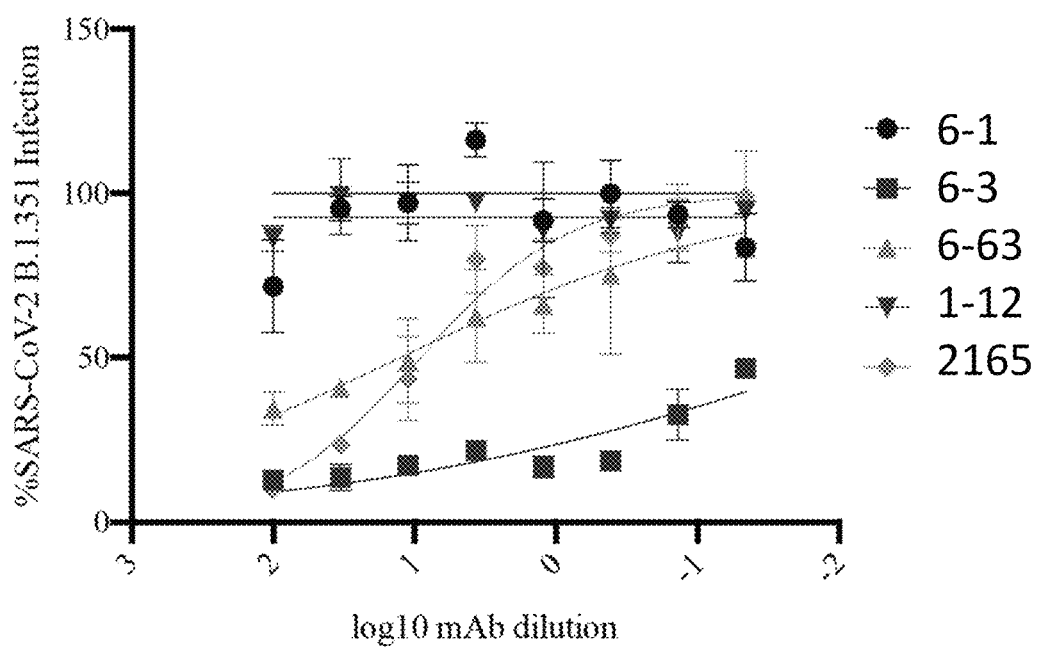
Figure 12C:
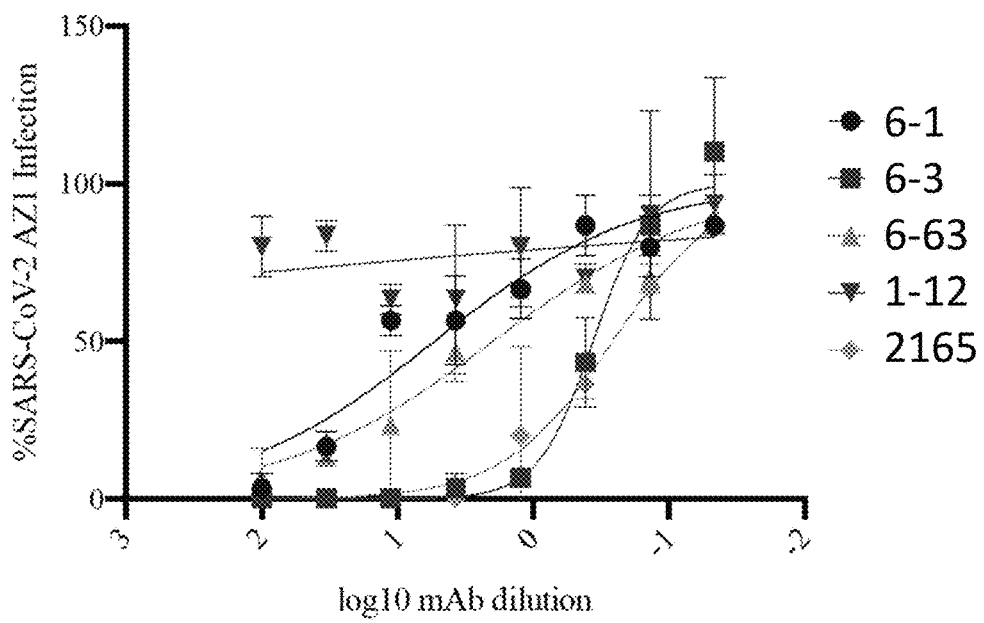
Figure 12D:
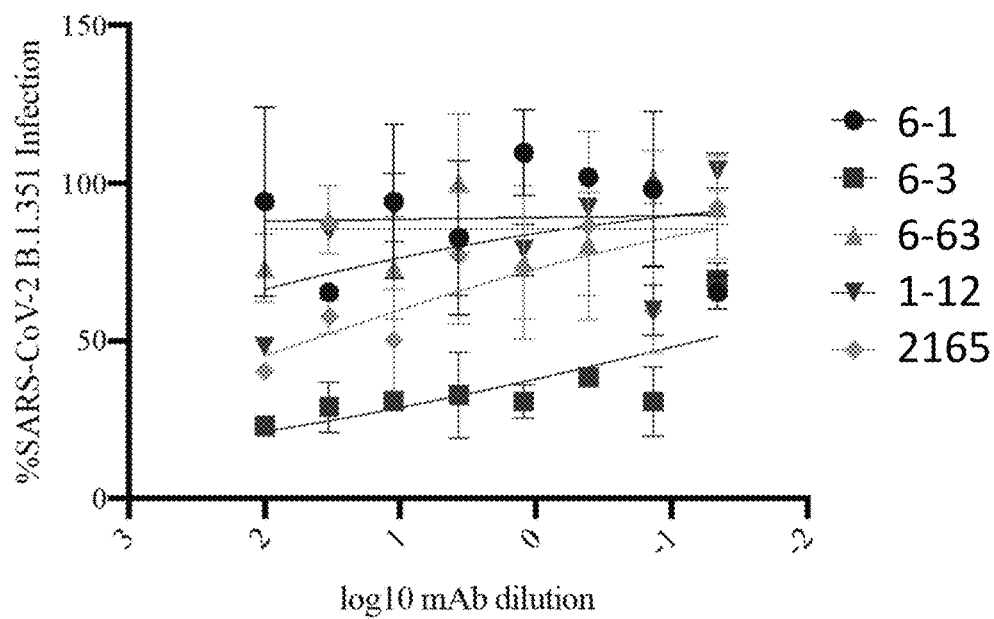

Based on the aggregate data from the Vero E6 flow cytometry assay, competition binning analysis, and neutralization assays, it was hypothesized that many of the candidates bound divergent sites on SARS-CoV-2 S1. To test this, a shotgun mutagenesis library of SARS-CoV-2 S protein RBD mutants were generated and screened the binding of neutralizing candidates to cells expressing these mutants. This approach allowed for defining which amino acids were critical to the binding of each neutralizing antibody. As shown in FIGS. 7A-7C, most neutralizing mAbs bound the RBD, although the overall binding pattern of the VHH RBD-binding mAbs (6-1, 6-3, and 6-63) differed from that of the IgG RBD-binding mAbs (2-5, 2-2, 2-6). Whereas residues in the ACE2-binding site of the RBD were critical for the VHH RBD-binders, more occluded residues mediated the binding of the 2-5 and 2-2 IgG candidates. 2-6, an IgG, bound a unique site that extended beyond the RBD (FIG. 7A and FIG. 7C). Although most of the neutralizing mAbs mapped bound to S1 RBD, there was one notable exception: 1-12. The inability of this candidate to inhibit the binding of S1 RBD to ACE2 in the Vero E6 flow cytometry assay indicated the position of a binding epitope outside the RBD. To clarify this, the shotgun mutagenesis approach was extended beyond the RBD. Critical residues for the binding of 1-12 were found in the NTD of the S1 subunit (FIGS. 7A-7C).

Materials and Methods

Epitope mapping was performed essentially as described previously, using a SARS-CoV-2 (strain Wuhan-Hu-1) S protein RBD shotgun mutagenesis mutation library, made using a full-length expression construct for S protein, where residues of S1 were individually mutated to alanine, and alanine residues to serine. Mutations were confirmed by DNA sequencing, and clones arrayed in a 384-well plate, one mutant per well. Binding of mAbs to each mutant clone in the alanine scanning library was determined, in duplicate, by high-throughput flow cytometry. Each S protein mutant was transfected into HEK-293T cells and allowed to express for 22 hrs. Cells were fixed in 4% (v/v) paraformaldehyde (Electron Microscopy Sciences), and permeabilized with 0.1% (w/v) saponin (Sigma-Aldrich) in PBS plus calcium and magnesium (PBS++) before incubation with mAbs diluted in PBS++, 10% normal goat serum (Sigma), and 0.1% saponin. MAb screening concentrations were determined using an independent immunofluorescence titration curve against cells expressing wild-type S protein to ensure that signals were within the linear range of detection. Antibodies were detected using 3.75 μg/mL of AlexaFluor488-conjugated secondary antibody (Jackson ImmunoResearch Laboratories) in 10% normal goat serum with 0.1% saponin. Cells were washed three times with PBS++/0.1% saponin followed by two washes in PBS and mean cellular fluorescence was detected using a high-throughput Intellicyte iQue flow cytometer (Sartorius). Antibody reactivity against each mutant S protein clone was calculated relative to wild-type S protein reactivity by subtracting the signal from mock-transfected controls and normalizing to the signal from wild-type S-transfected controls. Mutations within clones were identified as critical to the mAb epitope if they did not support reactivity of the test mAb but supported reactivity of other SARS-CoV-2 antibodies. This counter-screen strategy facilitates the exclusion of S mutants that are locally misfolded or have an expression defect. Validated critical residues represent amino acids whose side chains make the highest energetic contributions to the mAb-epitope interaction.

A subset of antibodies was also submitted for epitope mapping by high-throughput SPR and negative-stain electron microscopy by the CoVIC consortium. IgGs were cleaved by either IdeS (Promega) or papain (Sigma) and purified by ion exchange chromatography with MonoQ column (GE). Purified Spike trimer (in normal S buffer) was mixed with Fab fragments (1:2 or 2:1 molar ratio) at RT for 3 hours or overnight. Complexes were then purified with Superdex 6. Samples were stained by 0.75% uranyl formate with standard protocol. Datasets were collected by the Halo Titian electron microscope (Thermo Fisher Scientific).

Example 6: SARS-CoV-2 Variants

Different variants of SARS-CoV-2 are listed in Table 5. Different SARS-CoV-2 variants may alter the epitopes that a given antibody binds to and affect immunity.

TABLE 5

SARS-CoV-2 variants

|  | B.1.1.7 | B.1.351 | P.1 |
|---|---|---|---|
| Alternate name | 501Y.V1 | 501Y.V2 | 501Y.V3 |
| Mutations | 23 | 21 | 17 |
| Spike mutations | 8 | 9 | 10 |
| Key RBD, spike mutations beyond N501Y in all | E69/70 deletion, P681H 144Y deletion, A570D | E484K, K417N, orf1b deletion | E484, K417N/T, orf1b deletion |
| Other mutations, including N-terminal | T716I, S982A, D1118H | L18F, D80A, D215G, Δ242-244, R264I | L18F, T2ON, P26S and others |
| Transmissibility Δ | >40% increased | Not established | Not established |
| Lethality Δ | concern raised, not resolved | Not established | Not established |
| Immune escape | Not established | Probable, extent unclear (in vitro) | Not established |
| Countries reported (not = to local transmission) | 62 | 26 | 7 |

The tables in FIG. 8 highlight which mutations are located at the receptor binding domain (RBD). These mutations include G22813T, G23012A, A23063T, A23403g, K417N, E484K, N501Y, D641G for the 501Y.V2 variant (S. African), and A23063T and N501Y for the B.1.1.7, 501Y.V1 variant (UK).

Example 7: SPR Kinetics for 6-3 and 6-63

Figure 9A:
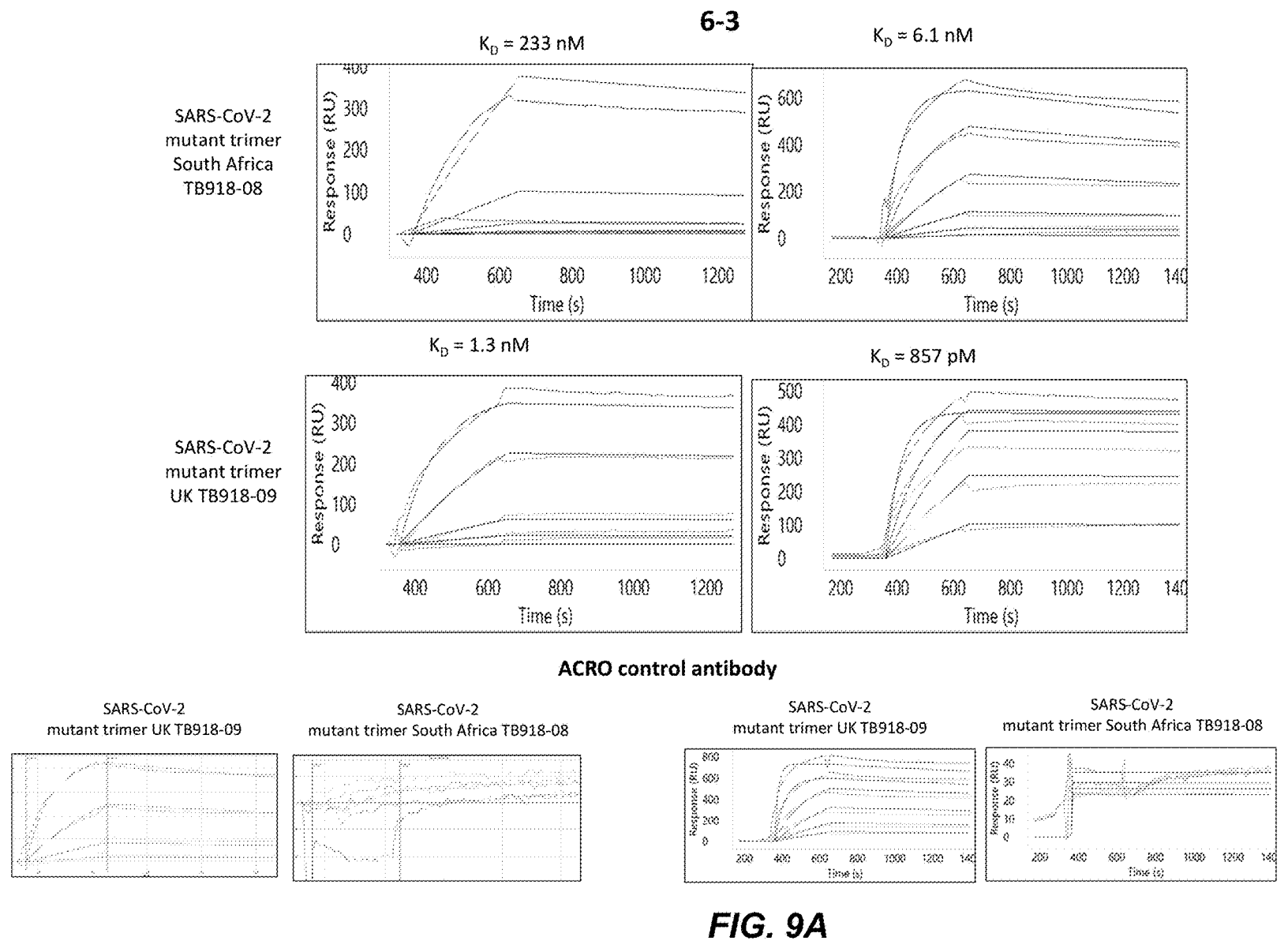

SPR kinetics were measured for SARS-COV-2 variant antibodies 6-3 and 6-63 against different SARS-COV-2 variant strains. The results are depicted in FIGS. 9A-9B and Table 6.

TABLE 6

| Protein | 6-3 | 6-63 |
|---|---|---|
| SARS-CoV-2 S1 | 11 nM | 65 nM |
| SARS-CoV-2 S1 (D614G) | 19 nM | 95 nM |
| SARS-CoV-2 S1 (P681H) | 12 nM | 16 nM |
| SARS-CoV-2 S1 (HV69-70del, N501Y, D614G) | 9.3 nM | 63 nM |
| SARS-CoV-2 S1 (HV69-70del, Y453F, D614G) | 23 nM | 96 nM |
| SARS-CoV-2 S1 (HV69-70del, Y144del, N501Y, A570D, D614G, P681H) | n/b* | 80 nM |
| SARS-CoV-2 S RBD (N501Y) | 0.71 nM | 3.8 nM |
| SARS-CoV-2 S RBD (Y453F) | 5.7 nM | 5.4 nM |
| SARS-CoV-2 S RBD (N439K) | 9.5 nM | 16 nM |
| SARS-CoV-2 S RBD (K417N) | 5.9 nM | 14 nM |
| SARS-CoV-2 S RBD (E484K) | 4.6 nM | 17 nM |
| SARS-CoV-2 S RBD (L452R) | n/b | n/b |
| SARS-CoV-2 S Trimer | 2.4 nM | 0.68 nM |
| SARS S1 | n/b | n/b |
| SARS-CoV-2 S1-Fc (South Africa 178-08) | 6.1 nM | 26.8 nM |
| SARS-CoV-2 S1-Fc (UK 178-09) | 857 pM | 332 pM |

Example 8: Analysis of COVIC Antibody Binding Epitopes Against Variant SARS-CoV-2 Variants Antibodies that bind to the receptor-binding motif are highly sensitive to emerging mutations. However, antibodies that bind outside of the RBM (CoVIC-94, 6-3, RBD-6; CoVIC-23, 182-7, RBD-9; COVIC-21, 182-3, RBD-10) showed an increased resistance to emerging mutations. This includes antibodies that target the N-terminal domain (NT) of the 51 spike protein.

Figure 10:
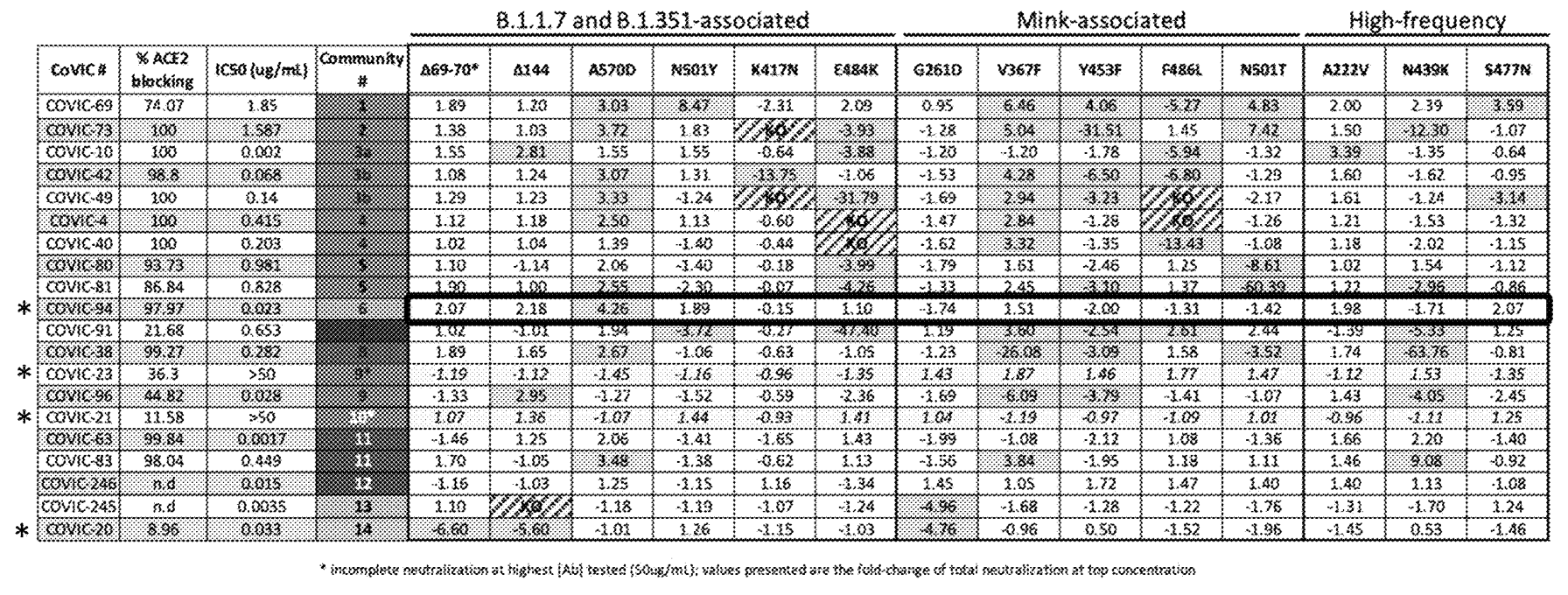

The IC50 of neutralizing antibodies against pseudoviruses with single mutations relative to the G614-parent virus was tested. Results are depicted in FIG. 10. Values about 2.5 and below −2.5 indicate an increase and decrease in potency, respectively. "KO" indicates a complete loss of neutralization for the virus-antibody pair. 4 of the 6 variant antibodies tested, COVIC-94 (6-3), COVIC-23, COVIC-21 and COVIC-20 were resistant to variant SARS-CoV-2 variant mutations.

Example 9: VSV-Pseudotype SARS-CoV2 Neutralization Analysis for Variant SARS-CoV-2 Strains Serial semi-log dilutions of all test antibodies (TA) and control were prepared and mixed with the VSV-pseudotype virus in a 1:1 ratio for 1 h at RT followed by incubation over Vero cells (ATCC® CCL-81™) seeded at 60,000 cells per well at 37° C. The cells were lysed the following day and luciferase activity was measured to assess the potency of each TA to block viral entry into the Vero cells. All samples were run in triplicate. Data analysis was conducted using XLFit and Graphpad Prism.

The percent neutralization of 1-12, 6-3 and 6-63 were measured against single mutations and variant pseudovirus strains. Results are depicted in FIGS. 11A-11F. 6-63 showed the highest levels of neutralization against the α variant. 6-3 showed the highest levels of neutralization against the β variant. 1-12 showed the highest level of neutralization against the δ and E variant.

Example 10: Variant Live Testing

Two cell lines were used to test the ability of antibody variants to neutralize SARS-CoV-2 variants in live cells: Vero cells overexpressing human ACE2 and TMPRSS2 (VAT) and Vero cells without overexpression of ACE2 and TMPRSS2 (WHO cells). Vero cells were infected with variant strains of SARS-CoV-2 isolates. To assess the binding efficiency of this panel of antibodies, each antibody was incubated with $10^5$ VERO cells at 100 nM, a labeled secondary antibody was used to measure binding using flow cytometry. The binding of each antibody was compared to a baseline value, consisting of secondary antibody alone, to derive a Mean Fluorescence Intensity (MFI) over baseline (MFI/Baseline). Antibody variants 6-1, 6-3, 6-63, 1-12 and 2165 were tested against AZ1 (human SARS-CoV-2 isolate from Arizona 2020) and B.1.351 (South African variant)

The results are depicted in FIGS. 12A-12D and Table 7. The epitopes that 6-1 and 1-21 recognize in AZ1 is not present in B.1.351 as there is no detectable neutralization to B.1.351 but there is to AZ1. mAb 6-3 seems to have better efficacy of neutralization of B.1.351 in comparison to AZ1. Overall, the V.A.T cell assay provides a higher level of sensitivity while using much less virus.

TABLE 7

| | EC50 [ng/mL] V.A.T Cells | | EC50 [ng/mL] WHO Cells | |
|---|---|---|---|---|
| | AZ1 | B.1.351 | AZ1 | B.1.351 |
| 202-1 | 211.9 | ND | 5313 | ND |
| 202-3 | 207 | 8.195 | 361.2 | 62.53 |

TABLE 7-continued

| | EC50 [ng/mL] V.A.T Cells | | EC50 [ng/mL] WHO Cells | |
|---|---|---|---|---|
| | AZ1 | B.1.351 | AZ1 | B.1.351 |
| 202-63 | 131.2 | 12760 | 202-63 1967 | 0 |
| 181-8 | 32450 | ND | 181-8 ND | ND |
| h2165 | 72.68 | 9154 | h2165 260 | 46680 |

Example 11. Sequences

Tables 8-30 show exemplary sequences for CDRH1-H3 and CDRL1-L3 as well as variant heavy chains and variant light chains for the SARS-CoV-2 and ACE2 variants.

TABLE 8

ACE2 VHH Variable Heavy Chain CDRs

| Variant | SEQ ID NO | CDRH1 | SEQ ID NO | CDRH2 | SEQ ID NO | CDRH3 |
|---|---|---|---|---|---|---|
| 4-1 | 1 | RTFSDDTMG | 51 | GGISWSGGNTYYA | 101 | CATDPPLFW |
| 4-2 | 2 | RTFGDYIMG | 52 | AAINWSAGYTAYA | 102 | CARASPNTGWHFDRW |
| 4-3 | 3 | RTFSDDAMG | 53 | AAINWSGGTTRYA | 103 | CATDPPLFW |
| 4-4 | 4 | RTFGDYIMG | 54 | AAINWIAGYTADA | 104 | CAEPSPNTGWHFDHW |
| 4-5 | 5 | RTFGDDTMG | 55 | AAINWSGGNTYYA | 105 | CATDPPLFW |
| 4-6 | 6 | RTFGDDTMG | 56 | AAINWTGGYTPYA | 106 | CATDPPLFW |
| 4-7 | 7 | RTFGDYIMG | 57 | AAINWSGGYTAYA | 107 | CATASPNTGWHFDHW |
| 4-8 | 8 | RTFGDYIMG | 58 | GGINWSGGYTYYA | 108 | CATDPPLFW |
| 4-9 | 9 | RTFGDYIMG | 59 | AAINWSGGYTHYA | 109 | CATDPPLFW |
| 4-10 | 10 | RTFSDDTMG | 60 | AAIHWSGSSTRYA | 110 | CATDPPLFW |
| 4-11 | 11 | RTFGDYAMG | 61 | APINWSGGSTYYA | 111 | CATDPPLFW |
| 4-12 | 12 | RTFGDDTMG | 62 | AAINWSGGNTPYA | 112 | CATDPPLFW |
| 4-13 | 13 | RTFGDDTMG | 63 | AAINWSGDNTHYA | 113 | CATDPPLFW |
| 4-14 | 14 | RTFSDDTMG | 64 | AAINWSGGTTRYA | 114 | CATDPPLFW |
| 4-15 | 15 | RTFSDDTMG | 65 | AAINWSGDSTYYA | 115 | CATDPPLFW |
| 4-16 | 16 | RTFSDYTMG | 66 | AAINWSGGYTYYA | 116 | CATDPPLFW |
| 4-17 | 17 | RTFGDDTMG | 67 | AAINWSGGNTDYA | 117 | CATDPPLFW |
| 4-18 | 18 | RTFGDYIMG | 68 | AAINWSGGYTPYA | 118 | CATDPPLFW |
| 4-19 | 19 | RTFSDDTMG | 69 | AAINWSGGSTYYA | 119 | CATDPPLFW |
| 4-20 | 20 | RTFGDDIMG | 70 | AAIHWSAGYTRYA | 120 | CATDPPLFWGHVDLW |
| 4-21 | 21 | RTFSDDTMG | 71 | AGMTWSGSSTFYA | 121 | CATDPPLFW |
| 4-22 | 22 | RTFGDYIMG | 72 | AAINWSGDNTHYA | 122 | CATDPPLFW |
| 4-23 | 23 | RTFSDDAMG | 73 | AGISWNGGSIYYA | 123 | CATDPPLFW |

TABLE 8-continued

ACE2 VHH Variable Heavy Chain CDRs

| Variant | SEQ ID NO | CDRH1 | SEQ ID NO | CDRH2 | SEQ ID NO | CDRH3 |
|---|---|---|---|---|---|---|
| 4-24 | 24 | RTFSDYTMG | 74 | AAINWSGGTTYYA | 124 | CATDPPLFW |
| 4-25 | 25 | GTFSRYAMG | 75 | SAVDSGGSTYYA | 125 | CAASPSLRSAWQW |
| 4-26 | 26 | RTFSDDTMG | 76 | AAVNWSGGSTYYA | 126 | CATDPPLFW |
| 4-27 | 27 | RTFGDYIMG | 77 | AAINWSAGYTAYA | 127 | CARATPNTGWHFDH

TABLE 9

SARS-CoV-2 S1 Variable Heavy Chain CDRs

| Variant | SEQ ID NO | CDRH1 | SEQ ID NO | CDRH2 | SEQ ID NO | CDRH3 |
|---|---|---|---|---|---|---|
| 2-1 | 151 | FTFSNYATD | 166 | SIISGSGGATYYA | 181 | CAKGGYCSSDTCWWEYWLDPW |
| 2-2 | 152 | FTFSRHAMN | 167 | SGISGSGDETYYA | 182 | CARDLPASYYDSSGYYWHNGMDVW |
| 2-3 | 153 | FTFSDFAMA | 168 | SAISGSGDITYYA | 183 | CAREADCLPSPWYLDLW |
| 2-4 | 154 | FTFSDFAMA | 169 | SAITGTGDITYYA | 184 | CAREADGLHSPW |
| 2-5 | 155 | FTFSDFAMA | 170 | SAISGSGDITYYA | 185 | CAREADGLHSPWHFDLW |
| 2-6 | 156 | FTFSDFAMA | 171 | SAISGSGDITYYA | 186 | CAREADGLHSPWHFDLW |
| 2-7 | 157 | FTFSDFAMA | 172 | SAITGSGDITYYA | 187 | CAREADGLHSPWHFDLW |
| 2-8 | 158 | FTFSDFAMA | 173 | SAISGSGDITYYA | 188 | CAREADGLHSPWHFDLW |
| 2-9 | 159 | FTFPRYAMS | 174 | STISGSGSTTYYA | 189 | CARLIDAFDIW |
| 2-10 | 160 | FTFSAFAMG | 175 | SAITASGDITYYA | 190 | CARQSDGLPSPWHFDLG |
| 2-11 | 161 | FTFSNYPMN | 176 | STISGSGGNTFYA | 191 | CVRHDEYSFDYW |
| 2-12 | 162 | FTFSDYPMN | 177 | STISGSGGITFYA | 192 | CVRHDEYSFDYW |
| 2-13 | 163 | FTFSDYPMN | 178 | SAISGSGDNTYYA | 193 | CVRHDEYSFDYW |
| 2-14 | 164 | FTFSDYPMN | 179 | SAITGSGDITYYA | 194 | CVRHDEYSFDYW |
| 2-15 | 165 | FTFSDYPMN | 180 | STISGSGGITFYA | 195 | CVRHDEYSFDYW |

TABLE 10

SARS-CoV-2 S1 Variable Light Chain CDRs

| Variant | SEQ ID NO | CDRL1 | SEQ ID NO | CDRL2 | SEQ ID NO | CDRL3 |
|---|---|---|---|---|---|---|
| 2-1 | 196 | RASQSIHRFLN | 211 | AASNLHS | 226 | CQQSYGLPPTF |
| 2-2 | 197 | RASQTINTYLN | 212 | SASTLQS | 227 | CQQSYSTFTF |
| 2-3 | 198 | RASQNIHTYLN | 213 | AASTFAK | 228 | CQQSYSAPPYTF |
| 2-4 | 199 | RASQSIDTYLN | 214 | AASALAS | 229 | CQQSYSAPPYTF |
| 2-5 | 200 | RASQSIHTYLN | 215 | AASALAS | 230 | CQQSYSAPPYTF |
| 2-6 | 201 | RASQSIDTYLN | 216 | AASALAS | 231 | CQQSYSAPPYTF |
| 2-7 | 202 | RASQSIDTYLN | 217 | AASALAS | 232 | CQQSYSAPPYTF |
| 2-8 | 203 | RASQSIDTYLN | 218 | AASALAS | 233 | CQQSYSAPPYTF |
| 2-9 | 204 | RASQRIGTYLN | 219 | AASNLEG | 234 | CQQNYSTTWTF |
| 2-10 | 205 | RASQSIHISLN | 220 | LASPLAS | 235 | CQQSYSAPPYTF |
| 2-11 | 206 | RASQSIGNYLN | 221 | GVSSLQS | 236 | CQQSHSAPLTF |

TABLE 10-continued

SARS-CoV-2 S1 Variable Light Chain CDRs

| Variant | SEQ ID NO | CDRL1 | SEQ ID NO | CDRL2 | SEQ ID NO | CDRL3 |
|---|---|---|---|---|---|---|
| 2-12 | 207 | RASQSIDNYLN | 222 | GVSALQS | 237 | CQQSHSAPPYFF |
| 2-13 | 208 | RASQSIDTYLN | 223 | GASALES | 238 | CQQSHSAPPYFF |
| 2-14 | 209 | RASQSIDTYLN | 224 | GVSALQS | 239 | CQQSYSAPPYFF |
| 2-15 | 210 | RASQSIDNYLN | 225 | GVSALQS | 240 | CQQSHSAPLTF |

TABLE 11

ACE2 Variable Heavy Chain CDRs

| Variant | SEQ ID NO | CDRH1 | SEQ ID NO | CDRH2 | SEQ ID NO | CDRH3 |
|---|---|---|---|---|---|---|
| 3-1 | 241 | FMFGNYAMS | 256 | AAISGSGGSTYYA | 271 | CAKDRGYSSSWYGGFDYW |
| 3-2 | 242 | FTFRSHAMN | 257 | SAISGSGGSTNYA | 272 | CARGLKFLEWLPSAFDIW |
| 3-3 | 243 | FTFRNYAMA | 258 | SGISGSGGTTYYG | 273 | CARGTRFLEWSLPLDVW |
| 3-4 | 244 | FTFRNHAMA | 259 | SGISGSGGTTYYG | 274 | CARGTRFLQWSLPLDVW |
| 3-5 | 245 | FTITNYAMS | 260 | SGISGSAGTYYA | 275 | CARHAWWKGAGFFDHW |
| 3-6 | 246 | FTIPNYAMS | 261 | SGISGAGASTYYA | 276 | CARHTWWKGAGFFDHW |
| 3-7 | 247 | FTIPNYAMS | 262 | SGISGSGASTYYA | 277 | CARHTWWKGAGFFDHW |
| 3-8 | 248 | FTITNYAMS | 263 | SGISGSGASTYYA | 278 | CARHTWWKGAGFFDHW |
| 3-9 | 249 | FTITNYAMS | 264 | SGISGSGAGTYYA | 279 | CARHTWWKGAGFFDHW |
| 3-10 | 250 | FTFRSHAMS | 265 | SSISGGGASTYYA | 280 | CARVKYLTTSSGWPRPYFDNW |
| 3-11 | 251 | FTIRNYAMS | 266 | SSISGGGASTYYA | 281 | CARVKYLTTSSGWPRPYFDNW |
| 3-12 | 252 | FTFRSHAMS | 267 | SSISGGGASTYYA | 282 | CARVKYLTTSSGWPRPYFDNW |
| 3-13 | 253 | FTFRSHAMS | 268 | SSISGGGASTYYA | 283 | CARVKYLTTSSGWPRPYFDNW |
| 3-14 | 254 | FTFRSYAMS | 269 | SSISGGGASTYYA | 284 | CARVKYLTTSSGWPRPYFDNW |
| 3-15 | 255 | FTFSAYSMS | 270 | SAISGSGGSRYYA | 285 | CGRSKWPQANGAFDIW |

TABLE 12

ACE2 Variable Light Chain CDRs

| Name | SEQ ID NO | CDRL1 | SEQ ID NO | CDRL2 | SEQ ID NO | CDRL3 |
|---|---|---|---|---|---|---|
| 3-1 | 286 | RASQTIYSYLN | 301 | ATSTLQG | 316 | CQHRGTF |
| 3-2 | 287 | RTSQSINTYLN | 302 | GASNVQS | 317 | CQQSYRIPRTF |
| 3-3 | 288 | RASRSISRYLN | 303 | AASSLQA | 318 | CQQSYSSLLTF |
| 3-4 | 289 | RASRSIRRYLN | 304 | ASSSLQA | 319 | CQQSYSTLLTF |
| 3-5 | 290 | RASQSIGRYLN | 305 | AASSLKS | 320 | CQQSYSLPRTF |
| 3-6 | 291 | RASQSIGKYLN | 306 | ASSSLQS | 321 | CQQSYSPPFTF |
| 3-7 | 292 | RASQSIGRYLN | 307 | ASSSLQS | 322 | CQQSYSLPRTF |
| 3-8 | 293 | RASQSIGRYLN | 308 | AASSLKS | 323 | CQQSYSLPLTF |
| 3-9 | 294 | RASQSIGRYLN | 309 | AASSLKS | 324 | CQQSYSLPRTF |
| 3-10 | 295 | RASQSIRKYLN | 310 | ASSTLQR | 325 | CQQSLSTPFTF |
| 3-11 | 296 | RASQSIGKYLN | 311 | ASSTLQR | 326 | CQQSLSPPFTF |
| 3-12 | 297 | RASQSIGKYLN | 312 | ASSTLQR | 327 | CQQSLSTPFTF |
| 3-13 | 298 | RASQSIGKYLN | 313 | ASSTLQR | 328 | CQQSFSPPFTF |
| 3-14 | 299 | RASQSIGKYLN | 314 | ASSTLQR | 329 | CQQSFSTPFTF |
| 3-15 | 300 | RASQNIKTYLN | 315 | AASKLQS | 330 | CQQSYSTSPTF |

TABLE 13

SARS-CoV-2 S1 Variable Heavy Chain CDRs

| Name | SEQ ID NO | CDRH1 | SEQ ID NO | CDRH2 | SEQ ID NO | CDRH3 |
|---|---|---|---|---|---|---|
| 2-1 | 331 | FTFSNYATD | 358 | SIISGSGATYYA | 385 | CAKGGYCSSDTCWWEYWLDPW |
| 2-10 | 332 | FTFSAFAMG | 359 | SAITASGDITYYA | 386 | CARQSDGLPSPWHFDLG |
| 2-5 | 333 | FTFSDFAMA | 360 | SAISGSGDITYYA | 387 | CAREADGLHSPWHFDLW |
| 2-2 | 334 | FTFSRHAMN | 361 | SGISGSGDETYYA | 388 | CARDLPASYYDSSGYYWHNGMDVW |
| 2-4 | 335 | FTFSDFAMA | 362 | SAISGSGDITYYA | 389 | CAREADGLHSPWHFDLW |
| 2-6 | 336 | FTFSNYPMN | 363 | STISGSGGNTFYA | 390 | CVRHDEYSFDYW |
| 2-11 | 337 | FTFSDFAMA | 364 | SAITGSGDITYYA | 391 | CAREADGLHSPWHFDLW |
| 2-12 | 338 | FTFSDYPMN | 365 | STISGSGGITFYA | 392 | CVRHDEYSFDYW |
| 2-13 | 339 | FTFSDYPMN | 366 | SAISGSGDNTYYA | 393 | CVRHDEYSFDYW |
| 2-14 | 340 | FTFSDFAMA | 367 | SAITGTGDITYYA | 394 | CAREADGLHSPW |
| 2-7 | 341 | FTFSDYPMN | 368 | SAITGSGDITYYA | 395 | CVRHDEYSFDYW |

TABLE 13-continued

SARS-CoV-2 S1 Variable Heavy Chain CDRs

| Name | SEQ ID NO | CDRH1 | SEQ ID NO | CDRH2 | SEQ ID NO | CDRH3 |
|---|---|---|---|---

TABLE 14-continued

| SARS-CoV-2 S1 Variable Light Chain CDRs | | | | | | |
|---|---|---|---|---|---|---|
| Name | SEQ ID NO | CDRL1 | SEQ ID NO | CDRL2 | SEQ ID NO | CDRL3 |
| 2-12 | 419 | RASQSIDNYLN | 446 | GVSALQS | 473 | CQQSHSAPPYFF |
| 2-13 | 420 | RASQSIDTYLN | 447 | GASALES | 474 | CQQSHSAPPYFF |
| 2-14 | 421 | RASQSIDTYLN | 448 | AASALAS | 475 | CQQSYSAPPYTF |
| 2-7 | 422 | RASQSIDTYLN | 449 | GVSALQS | 476 | CQQSYSAPPYFF |
| 2-8 | 423 | RASQSIDTYLN | 450 | AASALAS | 477 | CQQSYSAPPYTF |
| 2-15 | 424 | RASQSIDNYLN | 451 | GVSALQS | 478 | CQQSHSAPLTF |
| 2-9 | 425 | RASQRIGTYLN | 452 | AASNLEG | 479 | CQQNYSTTWTF |
| 2-16 | 426 | TGTSSDVGSYDLVS | 453 | EGNKRPS | 480 | CCSYAGSSVVF |
| 2-17 | 427 | TGTSSDVGSSNLVS | 454 | EGSKRPS | 481 | CCSYAGSLYVF |
| 2-18 | 428 | TGTSSDIGSYNLVS | 455 | EGTKRPS | 482 | CCSYAGSRTYVF |
| 2-19 | 429 | TGTSTDVGSYNLVS | 456 | EGTKRPS | 483 | CCSYAGSYTSVVF |
| 2-2 | 430 | TGTSSNVGSYNLVS | 457 | EGTKRPS | 484 | CCSYAGSSSFVVF |
| 2-21 | 431 | RASQSIHTYLN | 458 | AASALAS | 485 | CQQSYSAPPYTF |
| 2-22 | 432 | RASQSIHTYLN | 459 | AASALAS | 486 | CQQSYSAPPYTF |
| 2-23 | 433 | RASQTINTFLN | 460 | SASTLQS | 487 | CQQSYSTFTF |
| 2-24 | 434 | RASQTIRTYLN | 461 | DASTLQR | 488 | CQQSYRTPPWTF |
| 2-25 | 435 | RSSQSISSYLN | 462 | GASRLRS | 489 | CQQGYSAPWTF |
| 2-26 | 436 | RASQSISGSLN | 463 | AESRLHS | 490 | CQQSYSPPQTF |
| 2-27 | 437 | RASRSISTYLN | 464 | AASNLQG | 491 | CQQSHSIPRTF |
| 2-28 | 438 | RASQSIHTYLN | 465 | AASALAS | 492 | CQQSYSAPPYTF |

TABLE 15

| SARS-CoV-2 S1 Variant Sequences Variable Heavy Chain | | |
|---|---|---|
| Name | SEQ ID NO | Amino Acid Sequence |
| 2-1 | 493 | EVQLLESGGGLVQPGGSLRLSCAASGFTFSNYATDWVRQAPGKGLEWVS IISGSGGATYYADSVKGRFTISRDNSKNTLYLQMNSLRAEDTAVYYCAKG GYCSSDTCWWEYWLDPWGQGTLVTVSS |
| 2-10 | 494 | EVQLLESGGGLVQPGGSLRLSCAASGFTFSAFAMGWVRQAPGKGLEWV SAITASGDITYYADSVKGRFTISRDNSKNTLYLQMNSLRAEDTAVYYCAR QSDGLPSPWHFDLGGQGTLVTVSS |
| 2-5 | 495 | EVQLLESGGGLVQPGGSLRLSCAASGFTFSDFAMAWVRQAPGKGLEWV SAISGSGDITYYADSVKGRFTISRDNSKNTLYLQMNSLRAEDTAVYYCAR EADGLHSPWHFDLWGQGTLVTVSS |
| 2-2 | 496 | EVQLLESGGGLVQPGGSLRLSCAASGFTFSRHAMNWVRQAPGKGLEWV SGISGSGDETYYADSVKGRFTISRDNSKNTLYLQMNSLRAEDTAVYYCA RDLPASYYDSSGYYWHNGMDVWGQGTLVTVSS |
| 2-4 | 497 | EVQLLESGGGLVQPGGSLRLSCAASGFTFSDFAMAWVRQAPGKGLEWV SAISGSGDITYYADSVKGRFTISRDNSKNTLYLQMNSLRAEDTAVYYCAR EADGLHSPWHFDLWGQGTLVTVSS |
| 2-6 | 498 | EVQLLESGGGLVQPGGSLRLSCAASGFTFSNYPMNWVRQAPGKGLEWV STISGSGGNTFYADSVKGRFTISRDNSKNTLYLQMNSLRAEDTAVYYCVR HDEYSFDYWGQGTLVTVSS |

TABLE 15-continued

SARS-CoV-2 S1 Variant Sequences Variable Heavy Chain

| Name | SEQ ID NO | Amino Acid Sequence |
|---|---|---|
| 2-11 | 499 | EVQLLESGGGLVQPGGSLRLSCAASGFTFSDFAMAWVRQAPGKGLEWV SAITGSGDITYYADSVKGRFTISRDNSKNTLYLQMNSLRAEDTAVYYCAR EADGLHSPWHFDLWGQGTLVTVSS |
| 2-12 | 500 | EVQLLESGGGLVQPGGSLRLSCAASGFTFSDYPMNWVRQAPGKGLEWV STISGSGGITFYADSVKGRFTISRDNSKNTLYLQMNSLRAEDTAVYYCVR HDEYSFDYWGQGTLVTVSS |
| 2-13 | 501 | EVQLLESGGGLVQPGGSLRLSCAASGFTFSDYPMNWVRQAPGKGLEWV SAISGSGDNTYYADSVKGRFTISRDNSKNTLYLQMNSLRAEDTAVYYCV RHDEYSFDYWGQGTLVTVSS |
| 2-14 | 502 | EVQLLESGGGLVQPGGSLRLSCAASGFTFSDFAMAWVRQAPGKGLEWV SAITGTGDITYYADSVKGRFTISRDNSKNTLYLQMNSLRAEDTAVYYCAR EADGLHSPWGQGTLVTVSS |
| 2-7 | 503 | EVQLLESGGGLVQPGGSLRLSCAASGFTFSDYPMNWVRQAPGKGLEWV SAITGSGDITYYADSVKGRFTISRDNSKNTLYLQMNSLRAEDTAVYYCVR HDEYSFDYWGQGTLVTVSS |
| 2-8 | 504 | EVQLLESGGGLVQPGGSLRLSCAASGFTFSDFAMAWVRQAPGKGLEWV SAISGSGDITYYADSVKGRFTISRDNSKNTLYLQMNSLRAEDTAVYYCAR EADGLHSPWHFDLWGQGTLVTVSS |
| 2-15 | 505 | EVQLLESGGGLVQPGGSLRLSCAASGFTFSDFAMAWVRQAPGKGLEWV SAISGSGDITYYADSVKGRFTISRDNSKNTLYLQMNSLRAEDTAVYYCAR EADGLHSPWHFDLWGQGTLVTVSS |
| 2-9 | 506 | EVQLLESGGGLVQPGGSLRLSCAASGFTFPRYAMSWVRQAPGKGLEWVS TISGSGSTTYYADSVKGRFTISRDNSKNTLYLQMNSLRAEDTAVYYCARL IDAFDIWGQGTLVTVSS |
| 2-16 | 507 | EVQLLESGGGLVQPGGSLRLSCAASGFTFSSYAMSWVRQAPGKGLEWVS VISGSGGSTYYADSVKGRFTISRDNSKNTLYLQMNSLRAEDTAVYYCAR EGYRDYLWYFDLWGQGTLVTVSS |
| 2-17 | 508 | EVQLLESGGGLVQPGGSLRLSCAASGFTFSNYAMSWVRQAPGKGLEWV SAISGSAGSTYYADSVKGRFTISRDNSKNTLYLQMNSLRAEDTAVYYCAR VRQGLRRTWYYFDYWGQGTLVTVSS |
| 2-18 | 509 | EVQLLESGGGLVQPGGSLRLSCAASGFTFSSYAMYWVRQAPGKGLEWV SAISGSAGSTYYADSVKGRFTISRDNSKNTLYLQMNSLRAEDTAVYYCAR DTNDFWSGYSIFDPWGQGTLVTVSS |
| 2-19 | 510 | EVQLLESGGGLVQPGGSLRLSCAASGFTFSSYTMSWVRQAPGKGLEWVS VISGSGGSTYYADSVKGRFTISRDNSKNTLYLQMNSLRAEDTAVYYCAR EGYRDYLWYFDLWGQGTLVTVSS |
| 2-2 | 511 | EVQLLESGGGLVQPGGSLRLSCAASGFTFSSYDMSWVRQAPGKGLEWVS VISGSGGSTYYADSVKGRFTISRDNSKNTLYLQMNSLRAEDTAVYYCAK GPLVGWYFDLWGQGTLVTVSS |
| 2-21 | 512 | EVQLLESGGGLVQPGGSLRLSCAASGFTFPRYAMSWVRQAPGKGLEWVS TISGSGSTTYYADSVKGRFTISRDNSKNTLYLQMNSLRAEDTAVYYCARL IDAFDIWGQGTLVTVSS |
| 2-22 | 513 | EVQLLESGGGLVQPGGSLRLSCAASGFTFTTYALSWVRQAPGKGLEWVS GISGSGDETYYADSVKGRFTISRDNSKNTLYLQMNSLRAEDTAVYYCTT GDDFWSGGNWFDPWGQGTLVTVSS |
| 2-23 | 514 | EVQLLESGGGLVQPGGSLRLSCAASGFTFSRHAMNWVRQAPGKGLEWV SGITGSGDETYYADSVKGRFTISRDNSKNTLYLQMNSLKAEDTAVYYCA RDLPASYYDSSGYYWHNGMDVWGQGTLVTVSS |
| 2-24 | 515 | EVQLLESGGGLVQPGGSLRLSCAASGFVFSSYAMSWVRQAPGKGLEWVS AISGSGGSSYYADSVKGRFTISRDNSKNTLYLQMNSLRAEDTAVYYCAR VGGGYWYGIDVWGQGTLVTVSS |
| 2-25 | 516 | EVQLLESGGGLVQPGGSLRLSCAASGFTLSSYVMSWVRQAPGKGLEWVS GISGGGASTYYADSVKGRFTISRDNSKNTLYLQMNSLRAEDTAVYYCAR GYSRNWYPSWFDPWGQGTLVTVSS |

TABLE 15-continued

| SARS-CoV-2 S1 Variant Sequences Variable Heavy Chain | | |
|---|---|---|
| Name | SEQ ID NO | Amino Acid Sequence |
| 2-26 | 517 | EVQLLESGGGLVQPGGSLRLSCAASGFTFSTYAMSWVRQAPGKGLEWVS SIGGSGSTTYYADSVKGRFTISRDNSKNTLYLQMNSLRAEDTAVYYCAG GWYLDYWGQGTLVTVSS |
| 2-27 | 518 | EVQLLGSGGGLVQPGGSLRLSCAASGFTYSNYAMTWVRQAPGKGLEWV SAISGSSGSTYYADSVKGRFTISRDNSKNTLYLQMNSLRAEDTAVYYCAS LCIVDPFDIWGQGTLVTVSS |
| 2-28 | 519 | EVQLLESGGGLVQPGGSLRLSCAASGFTFSNYPMNWVRQAPGKGLEWV STISGSGGNTFYADSVKGRFTISRDNSKNTLYLQMNSLRAEDTAVYYCVR HDEYSFDYWGQGTLVTVSS |

TABLE 16

| SARS-CoV-2 S1 Variant Sequences Variable Light Chain | | |
|---|---|---|
| Name | SEQ ID NO | Amino Acid Sequence |
| 2-1 | 520 | DIQMTQSPSSLSASVGDRVTITCRASQSIHRFLNWYQQKPGKAPKLLIYAA SNLHSGVPSRFSGSGSGTDFTLTISSLQPEDFATYYCQQSYGLPP-TFGQGTKVEIK |
| 2-10 | 521 | DIQMTQSPSSLSASVGDRVTITCRASQSIHISLNWYQQKPGKAPKLLIYLAS PLASGVPSRFSGSGSGTDFTLTISSLQPEDFATYYCQQSYSAPPYTFGQGTK VEIK |
| 2-5 | 522 | DIQMTQSPSSLSASVGDRVTITCRASQSIHTYLNWYQQKPGKAPKLLIYAA SALASGVPSRFSGSGSGTDFTLTISSLQPEDFATYYCQQSYSAPPYTFGQGT KVEIK |
| 2-2 | 523 | DIQMTQSPSSLSASVGDRVTITCRASQTINTYLNWYQQKPGKAPKLLIYSA STLQSGVPSRFSGSGSGTDFTLTISSLQPEDFATYYCQQSYSTFTFGQGTKV EIK |
| 2-4 | 524 | DIQMTQSPSSLSASVGDRVTITCRASQSIDTYLNWYQQKPGKAPKLLIYAA SALASGVPSRFSGSGSGTDFTLTISSLQPEDFATYYCQQSYSAPPYTFGQGT KVEIK |
| 2-6 | 525 | DIQMTQSPSSLSASVGDRVTITCRASQSIDTYLNWYQQKPGKAPKLLIYAA SALASGVPSRFSGSGSGTDFTLTISSLQPEDFATYYCQQSYSAPPYTFGQGT KVEIK |
| 2-11 | 526 | DIQMTQSPSSLSASVGDRVTITCRASQSIGNYLNWYQQKPGKAPKLLIYGV SSLQSGVPSRFSGSGSGTDFTLTISSLQPEDFATYYCQQSHSAPLTFGQGTK VEIK |
| 2-12 | 527 | DIQMTQSPSSLSASVGDRVTITCRASQSIDNYLNWYQQKPGKAPKLLIYGV SALQSGVPSRFSGSGSGTDFTLTISSLQPEDFATYYCQQSHSAPPYFFGQGT KVEIK |
| 2-13 | 528 | DIQMTQSPSSLSASVGDRVTITCRASQSIDTYLNWYQQKPGKAPKLLIYGA SALESGVPSRFSGSGSGTDFTLTISSLQPEDFATYYCQQSHSAPPYFFGQGT KVEIK |
| 2-14 | 529 | DIQMTQSPSSLSASVGDRVTITCRASQSIDTYLNWYQQKPGKAPKLLIYGV SALQSGVPSRFSGSGSGTDFTLTISSLQPEDFATYYCQQSYSAPPYFFGQGT KVEIK |
| 2-7 | 530 | DIQMTQSPSSLSASVGDRVTITCRASQSIDTYLNWYQQKPGKAPKLLIYAA SALASGVPSRFSGSGSGTDFTLTISSLQPEDFATYYCQQSYSAPPYTFGQGT KVEIK |
| 2-8 | 531 | DIQMTQSPSSLSASVGDRVTITCRASQSIDTYLNWYQQKPGKAPKLLIYAA SALASGVPSRFSGSGSGTDFTLTISSLQPEDFATYYCQQSYSAPPYTFGQGT KVEIK |
| 2-15 | 532 | DIQMTQSPSSLSASVGDRVTITCRASQSIDNYLNWYQQKPGKAPKLLIYGV SALQSGVPSRFSGSGSGTDFTLTISSLQPEDFATYYCQQSHSAPLTFGQGTK VEIK |

TABLE 16-continued

SARS-CoV-2 S1 Variant Sequences Variable Light Chain

| Name | SEQ ID NO | Amino Acid Sequence |
|---|---|---|
| 2-9 | 533 | DIQMTQSPSSLSASVGDRVTITCRASQRIGTYLNWYQQKPGKAPKLLIYAASNLEGGVPSRFSGSGSGTDFTLTISSLQPEDFATYYCQQNYSTTWTFGQGTKVEIK |
| 2-16 | 534 | DIQMTQSPSSLSASVGDRVTITCTGTSSDVGSYDLV TABLE 17-continued ACE2 Variable Heavy Chain CDRs

| Name | SEQ ID NO | CDRH1 | SEQ ID NO | CDRH2 | SEQ ID NO | CDRH3 |
|---|---|---|---|---|---|---|
| 3-7 | 549 | FMFGNYAMS | 578 | AAISGSGGSTYYA | 607 | CAKDRGYSSSWYGGFDYW |
| 3-1 | 550 | FTFRNHAMA | 579 | SGISGSGGTTYYG | 608 | CARGTRFLQWSLPLDVW |
| 3-5 | 551 | FTIPNYAMS | 580 | SGISGAGASTYYA | 609 | CARHTWWKGAGFFDHW |
| 3-6 | 552 | FTFRNYAMA | 581 | SGISGSGGTTYYG | 610 | CARGTRFLE

TABLE 17-continued

ACE2 Variable Heavy Chain CDRs

| Name | SEQ ID NO | CDRH1 | SEQ ID NO | CDRH2 | SEQ ID NO | CDRH3 |
|---|---|---|---|---|---|---|
| 3-27 | 573 | FTFDDYAMS | 602 | SGISGGGTSTYYA | 631 | CARDLYSSGWYGFDYW |
| 3-28 | 574 | FTFNNYAMN | 603 | SAISGSVGSTYYA | 632 | CARDNYDFWSGYYTNWFDPW |
| 3-29 | 575 | FTFTNHAMS | 604 | SAISGSGSNIYYA | 633 | CARDSLSVTMGRGVVTYYYYGMDFW |

TABLE 18

ACE2 Variant Sequences Variable Light Chain

| Name | SEQ ID NO | CDRL1 | SEQ ID NO | CDRL2 | SEQ ID NO | CDRL3 |
|---|---|---|---|---|---|---|
| 3-10 | 634 | RASQSIRKYLN | 663 | ASSTLQR | 692 | CQQSLSTPFTF |
| 3-4 | 635 | RASQNIKTYLN | 664 | AASKLQS | 693 | CQQSYSTSPTF |
| 3-7 | 636 | RASQTIYSYLN | 665 | ATSTLQG | 694 | CQHRGTF |
| 3-1 | 637 | RASRSIRRYLN | 666 | ASSSLQA | 695 | CQQSYSTLLTF |
| 3-5 | 638 | RASQSIGKYLN | 667 | ASSSLQS | 696 | CQQSYSPPFTF |
| 3-6 | 639 | RASRSISRYLN | 668 | AASSLQA | 697 | CQQSYSSLLTF |
| 3-15 | 640 | RASQSIGKYLN | 669 | ASSTLQR | 698 | CQQSLSPPFTF |
| 3-3 | 641 | RASQSIGRYLN | 670 | ASSSLQS | 699 | CQQSYSLPRTF |
| 3-11 | 642 | RASQSIGRYLN | 671 | AASSLKS | 700 | CQQSYSLPRTF |
| 3-8 | 643 | RASQSIGKYLN | 672 | ASSTLQR | 701 | CQQSLSTPFTF |
| 3-2 | 644 | RASQSIGRYLN | 673 | AASSLKS | 702 | CQQSYSLPLTF |
| 3-12 | 645 | RTSQSINTYLN | 674 | GASNVQS | 703 | CQQSYRIPRTF |
| 3-14 | 646 | RASQSIGKYLN | 675 | ASSTLQR | 704 | CQQSFSPPFTF |
| 3-9 | 647 | RASQSIGKYLN | 676 | ASSTLQR | 705 | CQQSFSTPFTF |
| 3-13 | 648 | RASQSIGRYLN | 677 | AASSLKS | 706 | CQQSYSLPRTF |
| 3-16 | 649 | RASQIIGSYLN | 678 | TTSNLQS | 707 | CQQSYITPWTF |
| 3-17 | 650 | RASQSISRYIN | 679 | EASSLES | 708 | CQQSHITPLTF |
| 3-18 | 651 | RASQSIYTYLN | 680 | SASNLHS | 709 | CQQSDTTPWTF |
| 3-19 | 652 | RASQSIATYLN | 681 | GASSLEG | 710 | CQQTFSSPFTF |
| 3-2 | 653 | RASQNINTYLN | 682 | SASSLQS | 711 | CQQSSLTPWTF |
| 3-21 | 654 | RASQGIATYLN | 683 | YASNLQS | 712 | CQQSYSTRFTF |
| 3-22 | 655 | RASERISNYLN | 684 | TASNLES | 713 | CQQSYTPPRTF |
| 3-23 | 656 | RASQSISSSLN | 685 | AASRLQD | 714 | CQQSYSTPRSF |
| 3-24 | 657 | RASQSISSHLN | 686 | RASTLQS | 715 | CQQTYNTPQTF |
| 3-25 | 658 | RASQSISSYLI | 687 | AASRLHS | 716 | CQGGYNTPRTF |
| 3-26 | 659 | RASPSISTYLN | 688 | TASRLQT | 717 | CQQTYSTPSSF |
| 3-27 | 660 | RASQNIAKYLN | 689 | GASGLQS | 718 | CQQSHSPPITF |
| 3-28 | 661 | RASQSIGTYLN | 690 | AASNLHS | 719 | CQESYSAPYTF |
| 3-29 | 662 | RASQSISPYLN | 691 | KASSLQS | 720 | CQQSSSTPYTF |

TABLE 19

ACE2 Variant Sequences Variable Heavy Chain

| Name | SEQ ID NO | Amino Acid Sequence |
|---|---|---|
| 3-10 | 721 | EVQLLESGGGLVQPGGSLRLSCAASGFTFRSHAMSWVRQAPGKGLEWVSSISGGGASTYYADSVKGRFTISRDNSKNTLYLQMNSLRAEDTAVYYCARVKYLTTSSGWPRPYFDNWGQGTLVTVSS |
| 3-4 | 722 | EVQLLESGGGLVQPGGSLRLSCAASGFTFSAYSMSWVRQAPGKGLEWVSAISGSGGSRYYADSVKGRFTISRDNSKNTLYLQMNSLRAEDTAVYYCGRSKWPQANGAFDIWGQGTLVTVSS |
| 3-7 | 723 | EVQLLESGGGLVQPGGSLRLSCAASGFMFGNYAMSWVRQAPGKGLEWVAAISGSGGSTYYADSVKGRFTISRDNSKNTLYLQMNSLRAEDTAVYYCAKDRGYSSSWYGGFDYWGQGTLVTVSS |
| 3-1 | 724 | EVQLLESGGGLVQPGGSLRLSCAASGFTFRNHAMAWVRQAPGKGLEWVSGISGSGGTTYYGDSVKGRFTISRDNSKNTLYLQMNSLRAEDTAVYYCARGTRFLQWSLPLDVWGQGTLVTVSS |

TABLE 19-continued

ACE2 Variant Sequences Variable Heavy Chain

| Name | SEQ ID NO | Amino Acid Sequence |
|---|---|---|
| 3-5 | 725 | EVQLLESGGGLVQPGGSLRLSCAASGFTIPNYAMSWVRQAPGKGLEWVSGISGAGASTYYADSVKGRFTISRDNSKNTLYLQMNSLRAEDTAVYYCARHTWWKGAGFFDHWGQGTLVTVSS |
| 3-6 | 726 | EVQLLESGGGLVQPGGSLRLSCAASGFTFRNYAMAWVRQAPGKGLEWVSGISGSGGTTYYGDSVKGRFTISRDNSKNTLYLQMNSLRAEDTAVYYCARGTRFLEWSLPLDVWGQGTLVTVSS |
| 3-15 | 727 | EVQLLESGGGLVQPGGSLRLSCAASGFTIRNYAMSWVRQAPGKGLEWVSSISGGASTYYADSVKGRFTISRDNSKNTLYLQMNSLRAEDTAVYYCARVKYLTTSSGWPRPYFDNWGQGTLVTVSS |
| 3-3 | 728 | EVQLLESGGGLVQPGGSLRLSCAASGFTIPNYAMSWVRQAPGKGLEWVSGISGSGASTYYADSVKGRFTISRDNSKNTLYLQMNSLRAEDTAVYYCARHTWWKGAGFFDHWGQGTLVTVSS |
| 3-11 | 729 | EVQLLESGGGLVQPGGSLRLSCAASGFTITNYAMSWVRQAPGKGLEWVSGISGSGAGTYYADSVKGRFTISRDNSKNTLYLQMNSLRAEDTAVYYCARHAWWKGAGFFDHWGQGTLVTVSS |
| 3-8 | 730 | EVQLLESGGGLVQPGGSLRLSCAASGFTFRSHAMSWVRQAPGKGLEWVSSISGGASTYYADSVKGRFTISRDNSKNTLYLQMNSLRAEDTAVYYCARVKYLTTSSGWPRPYFDNWGQGTLVTVSS |
| 3-2 | 731 | EVQLLESGGGLVQPGGSLRLSCAASGFTITNYAMSWVRQAPGKGLEWVSGISGSGASTYYADSVKGRFTISRDNSKNTLYLQMNSLRAEDTAVYYC ARHTWWKGAGFFDHWGQGTLVTVSS |
| 3-12 | 732 | EVQLLESGGGLVQPGGSLRLSCAASGFTFRSHAMNWVRQAPGKGLEWVSAISGSGGSTNYADSVKGRFTISRDNSKNTLYLQMNSLRAEDTAVYYCARGLKFLEWLPSAFDIWGQGTLVTVSS |
| 3-14 | 733 | EVQLLESGGGLVQPGGSLRLSCAASGFTFRSHAMSWVRQAPGKGLEWVSSISGGASTYYADSVKGRFTISRDNSKNTLYLQMNSLRAEDTAVYYCARVKYLTTSSGWPRPYFDNWGQGTLVTVSS |
| 3-9 | 734 | EVQLLESGGGLVQPGGSLRLSCAASGFTFRSYAMSWVRQAPGKGLEWVSSISGGASTYYADSVKGRFTISRDNSKNTLYLQMNSLRAEDTAVYYCARVKYLTTSSGWPRPYFDNWGQGTLVTVSS |
| 3-13 | 735 | EVQLLESGGGLVQPGGSLRLSCAASGFTITNYAMSWVRQAPGKGLEWVSGISGSGAGTYYADSVKGRFTISRDNSKNTLYLQMNSLRAEDTAVYYCARHTWWKGAGFFDHWGQGTLVTVSS |
| 3-16 | 736 | EVQLLESGGGLVQPGGSLRLSCAASGFTFTNFAMSWVRQAPGKGLEWVSAISGRGGGTYYADSVKGRFTISRDNSKNTLYLQMNSLRAEDTAVYYCARDAHGYYYDSSGYDDWGQGTLVTVSS |
| 3-17 | 737 | EVQLLESGGGLVQPGGSLRLSCAASGFTFRSYPMSWVRQAPGKGLEWVSTISGSGGITYYADSVKGRFTISRDNSKNTLYLQMNSLRAEDTAVYYCAKGVYGSTVTTCHWGQGTLVTVSS |
| 3-18 | 738 | EVQLLESGGGLVQPGGSLRLSCAASGFTLTSYAMSWVRQAPGKGLEWVSAISGSGVDTYYADSVKGRFTISRDNSKNTLYLQMNSLRAEDTAVYYCARPTNWGFDYWGQGTLVTVSS |
| 3-19 | 739 | EVQLLESGGGLVQPGGSLRLSCAASGFTFINYAMSWVRQAPGKGLEWVSTISTSGGNTYYADSVKGRFTISRDNSKNTLYLQMNSLRAEDTAVYYCARADSNWASSAYWGQGTLVTVSS |
| 3-2 | 740 | EVQLLESGGGLVQPGGSLRLSCAASGFPFSTYAMSWVRQAPGKGLEWVSGISVSGGFTYYADSVKGRFTISRDNS TABLE 19-continued ACE2 Variant Sequences Variable Heavy Chain

| Name | SEQ ID NO | Amino Acid Sequence |
|---|---|---|
| 3-23 | 743 | EVQLLESGGGLVQPGGSLRLSCAASGFTFSDYAMTWVRQAPGKGL EWVSDISGSGGSTYYADSVKGRFTISRDNSKNTLYLQMNSLRAEDT AVYYCARGTVTSFDFWGQGTLVTVSS |
| 3-24 | 744 | EVQLLESGGGLVQPGGSLRLSCAASGFTFSIYAMGWVRQAPGKGL EWVSFISGSGGSTYYADSVKGRFTISRDNSKNTLYLQMNSLRAEDT AVYYCAKDYHSASWFSAAADYWGQGTLVTVSS |
| 3-25 | 745 | EVQLLESGGGLVQPGGSLRLSCAASGFTFASYAMTWVRQAPGKGL EWVSAISESGGSTYYADSVKGRFTISRDNSKNTLYLQMNSLRAEDT AVYYCAREGQEYSSGSSYFDYWGQGTLVTVSS |
| 3-26 | 746 | EVQLLESGGGLVQPGGSLRLSCAASGFTFSEYAMSWVRQAPGKGL EWVSAITGSGGSTYYGDSVKGRFTISRDNSKNTLYLQMNSLRAEDT AVYYCARGSQTPYCGGDCPETFDYWGQGTLVTVSS |
| 3-27 | 747 | EVQLLESGGGLVQPGGSLRLSCAASGFTFDDYAMSWVRQAPGKGL EWVSGISGGGTSTYYADSVKGRFTISRDNSKNTLYLQMNSLRAEDT AVYYCARDLYSSGWYGFDYWGQGTLVTVSS |
| 3-28 | 748 | EVQLLESGGGLVQPGGSLRLSCAASGFTFNNYAMNWVRQAPGKG LEWVSAISGSVGSTYYADSVKGRFTISRDNSKNTLYLQMNSLRAED TAVYYCARDNYDFWSGYYTNWFDPWGQGTLVTVSS |
| 3-29 | 749 | EVQLLESGGGLVQPGGSLRLSCAASGFTFTNHAMSWVRQAPGKGL EWVSAISGSGSNIYYADSVKGRFTISRDNSKNTLYLQMNSLRAEDT AVYYCARDSLSVTMGRGVVTYYYYGMDFWGQGTLVTVSS |

TABLE 20

ACE2 Variant Sequences Variable Light Chain

| Name | SEQ ID NO | Amino Acid Sequence |
|---|---|---|
| 3-10 | 750 | DIQMTQSPSSLSASVGDRVTITCRASQSIRKYLNWYQQKPGKAPKLLIY ASSTLQRGVPSRFSGSGSGTDFTLTISSLQPEDFATYYCQQSLSTPFTFG GGTKVEIK |
| 3-4 | 751 | DIQMTQSPSSLSASVGDRVTITCRASRSIRRYLNWYQQKPGKAPKLLIY ASSSLQAGVPSRFSGSGSGTDFTLTISSLQPEDFATYYCQQSYSTLLTFG QGTKVEIK |
| 3-7 | 752 | DIQMTQSPSSLSASVGDRVTITCRASQSIGRYLNWYQQKPGKAPKLLIY ASSSLQSGVPSRFSGSGSGTDFTLTISSLQPEDFATYYCQQSYSLPRTFG QGTKVEIK |
| 3-1 | 753 | DIQMTQSPSSLSASVGDRVTITCRASQTIYSYLNWYQQKPGKAPKLLIY ATSTLQGGVPSRFSGSGSGTDFTLTISSLQPEDFATYYCQHRGTFGQGT KVEIK |
| 3-5 | 754 | DIQMTQSPSSLSASVGDRVTITCRASQSIGRYLNWYQQKPGKAPKLLIY AASSLKSGVPSRFSGSGSGTDFTLTISSLQPEDFATYYCQQSYSLPRTFG QGTKVEIK |
| 3-6 | 755 | DIQMTQSPSSLSASVGDRVTITCRASQSIGKYLNWYQQKPGKAPKLLIY ASSSLQSGVPSRFSGSGSGTDFTLTISSLQPEDFATYYCQQSYSPPFTFG QGTKVEIK |
| 3-15 | 756 | DIQMTQSPSSLSASVGDRVTITCRASQNIKTYLNWYQQKPGKAPKLLIY AASKLQSGVPSRFSGSGSGTDFTLTISSLQPEDFATYYCQQSYSTSPTFG QGTKVEIK |
| 3-3 | 757 | DIQMTQSPSSLSASVGDRVTITCRASRSISRYLNWYQQKPGKAPKLLIY AASSLQAGVPSRFSGSGSGTDFTLTISSLQPEDFATYYCQQSYSSLLTFG QGTKVEIK |
| 3-11 | 758 | DIQMTQSPSSLSASVGDRVTITCRASQSIGKYLNWYQQKPGKAPKLLIY ASSTLQRGVPSRFSGSGSGTDFTLTISSLQPEDFATYYCQQSLSPPFTFG QGTKVEIK |

TABLE 20-continued

ACE2 Variant Sequences Variable Light Chain

| Name | SEQ ID NO | Amino Acid Sequence |
|---|---|---|
| 3-8 | 759 | DIQMTQSPSSLSASVGDRVTITCRASQSIGRYLNWYQQKPGKAPKLLIYAASSLKSGVPSRFSGSGSGTDFTLTISSLQPEDFATYYCQQSYSLPLTFGQGTKVEIK |
| 3-2 | 760 | DIQMTQSPSSLSASVGDRVTITCRTSQSINTYLNWYQQKPGKAPKLLIYGASNVQSGVPSRFSGSGSGTDFTLTISSLQPEDFATYYCQQSYRIPRTFGQGTKVEIK |
| 3-12 | 761 | DIQMTQSPSSLSASVGDRVTITCRASQSIGKYLNWYQQKPGKAPKLLIYASSTLQRGVPSRFSGSGSGTDFTLTISSLQPEDFATYYCQQSLSTPFTFGQGTKVEIK |
| 3-14 | 762 | DIQMTQSPSSLSASVGDRVTITCRASQSIGKYLNWYQQKPGKAPKLLIYASSTLQRGVPSRFSGSGSGTDFTLTISSLQPEDFATYYCQQSFSTPFTFGQGTKVEIK |
| 3-9 | 763 | DIQMTQSPSSLSASVGDRVTITCRASQSIGRYLNWYQQKPGKAPKLLIYAASSLKSGVPSRFSGSGSGTDFTLTISSLQPEDFATYYCQQSYSLPRTFGQGTKVEIK |
| 3-13 | 764 | DIQMTQSPSSLSASVGDRVTITCRASQSIGKYLNWYQQKPGKAPKLLIYASSTLQRGVPSRFSGSGSGTDFTLTISSLQPEDFATYYCQQSFSPPFTFGQGTKVEIK |
| 3-16 | 765 | DIQMTQSPSSLSASVGDRVTITCRASQIIGSYLNWYQQKPGKAPKLLIYTTSNLQSGVPSRFSGSGSGTDFTLTISSLQPEDFATYYCQQSYITPWTFGQGTKVEIK |
| 3-17 | 766 | DIQMTQSPSSLSASVGDRVTITCRASQSISRYINWYQQKPGKAPKLLIYEASSLESGVPSRFSGSGSGTDFTLTISSLQPEDFATYYCQQSHITPLTFGQGTKVEIK |
| 3-18 | 767 | DIQMTQSPSSLSASVGDRVTITCRASQSIYTYLNWYQQKPGKAPKLLIYSASNLHSGVPSRFSGSGSGTDFTLTISSLQPEDFATYYCQQSDTTPWTFGQGTKVEIK |
| 3-19 | 768 | DIQMTQSPSSLSASVGDRVTITCRASQSIATYLNWYQQKPGKAPKLLIYGASSLEGGVPSRFSGSGSGTDFTLTISSLQPEDFATYYCQQTFSSPFTFGQGTKVEIK |
| 3-2 | 769 | DIQMTQSPSSLSASVGDRVTITCRASQNINTYLNWYQQKPGKAPKLLIYSASSLQSGVPSRFSGSGSGTDFTLTISSLQPEDFATYYCQQSSLTPWTFGQGTKVEIK |
| 3-21 | 770 | DIQMTQSPSSLSASVGDRVTITCRASQGIATYLNWYQQKPGKAPKLLIYYASNLQSGVPSRFSGSGSGTDFTLTISSLQPEDFATYYCQQSYSTRFTFGQGTKVEIK |
| 3-22 | 771 | DIQMTQSPSSLSASVGDRVTITCRASERISNYLNWYQQKPGKAPKLLIYTASNLESGVPSRFSGSGSGTDFTLTISSLQPEDFATYYCQQSYTPPRTFGQGTKVEIK |
| 3-23 | 772 | DIQMTQSPSSLSASVGDRVTITCRASQSISSSLNWYQQKPGKAPKLLIYAASRLQDGVPSRFSGSGSGTDFTLTISSLQPEDFATYYCQQSYSTPRSFGQGTKVEIK |
| 3-24 | 773 | DIQMTQSPSSLSASVGDRVTITCRASQSISSHLNWYQQKPGKAPKLLIYRASTLQSGVPSRFSGSGSGTDFTLTISSLQPEDFATYYCQQTYNTPQTFGQGTKVEIK |
| 3-25 | 774 | DIQMTQSPSSLSASVGDRVTITCRASQSISSYLIWYQQKPGKAPKLLIYAASRLHSGVPSRFSGSGSGTDFTLTISSLQPEDFATYYCQQGYNTPRTFGQGTKVEIK |
| 3-26 | 775 | DIQMTQSPSSLSASVGDRVTITCRASPSISTYLNWYQQKPGKAPKLLIYTASRLQTGVPSRFSGSGSGTDFTLTISSLQPEDFATYYCQQTYSTPSSFGQGTKVEIK |
| 3-27 | 776 | DIQMTQSPSSLSASVGDRVTITCRASQNIAKYLNWYQQKPGKAPKLLIYGASGLQSGVPSRFSGSGSGTDFTLTISSLQPEDFATYYCQQSHSPPITFGQGTKVEIK |
| 3-28 | 777 | DIQMTQSPSSLSASVGDRVTITCRASQSIGTYLNWYQQKPGKAPKLLIYAASNLHSGVPSRFSGSGSGTDFTLTISSLQPEDFATYYCQESYSAPYTFGQGTKVEIK |

TABLE 20-continued

ACE2 Variant Sequences Variable Light Chain

| Name | SEQ ID NO | Amino Acid Sequence |
|---|---|---|
| 3-29 | 778 | DIQMTQSPSSLSASVGDRVTITCRASQSISPYLNWYQQKPGKAPKLLIY KASSLQSGVPSRFSGSGSGTDFTLTISSLQPEDFATYYCQQSSSTPYTFG QGTKVEIK |

TABLE 21

ACE2 Variable Heavy Chain CDRs

| Name | SEQ ID NO | CDRH1 | SEQ ID NO | CDRH2 | SEQ ID NO | CDRH3 |
|---|---|---|---|---|---|---|
| 4-51 | 779 | PGTAIMG | 920 | ARISTSGGSTKYA | 1062 | CARTTVTTPPLIW |
| 4-52 | 780 | RSFSNSVMG | 921 | ARITWNGGSTYYA | 1063 | CATTENPNPRW |
| 4-53 | 781 | RTFGDDTMG | 922 | AAVSWSGSGVYYA | 1064 | CATDPPLFW |
| 4-54 | 782 | RTFSDARMG | 923 | GAVSWSGGTTVYA | 1065 | CATTEDPYPRW |
| 4-49 | 783 | RTFGDYIMG | 924 | AAINWSAGYTAYA | 1066 | CARASPNTGWHFDHW |
| 4-55 | 784 | SGLSINAMG | 925 | AAISWSGGSTYTAYA | 1067 | CAAYQAGWGDW |
| 4-39 | 785 | RTFSNAAMG | 926 | ARILWTGASRNYA | 1068 | CATTENPNPRW |
| 4-56 | 786 | FSLDYYGMG | 927 | AAISWNGDFTAYA | 1069 | CAKRANPTGAYFDYW |
| 4-33 | 787 | FTFSRHDMG | 928 | AGINWESGSTNYA | 1070 | CAADRGVYGGRWYRTSQYTW |
| 4-57 | 788 | LTFRNYAMG | 929 | AAIGSGGYTDYA | 1071 | CAVKPGWVARDPSQYNW |
| 4-25 | 789 | GTFSRYAMG | 930 | SAVDSGGSTYYA | 1072 | CAASPSLRSAWQW |
| 4-58 | 790 | FTLDYYDMG | 931 | AAVTWSGGSTYYA | 1073 | CAADRRGLASTRAADYDW |
| 4-59 | 791 | RTFGDYIMG | 932 | AAINWSAGYTPYA | 1074 | CATAPPLFCWHFDLW |
| 4-6 | 792 | RTFGDDIMG | 933 | AAIHWSAGYTRYA | 1075 | CATDPPLFWGHVDLW |
| 4-61 | 793 | RTFGDYIMG | 934 | AAINWSADYTPYA | 1076 | CATAPPNTGWHFDHW |
| 4-3 | 794 | RTFGDYIMG | 935 | AAINWSAGYTAYA | 1077 | CATATPNTGWHFDHW |
| 4-62 | 795 | RTFSDDTMG | 936 | AAINWSGGSTDYA | 1078 | CATDPPLFW |
| 4-43 | 796 | RTFGDDTMG | 937 | AGINWSGGNTYYA | 1079 | CATDPPLFW |
| 4-5 | 797 | RTFGDYIMG | 938 | AAINWTGGYTSYA | 1080 | CATDPPLFW |
| 4-42 | 798 | RTFGDDTMG | 939 | AAINWSGGNTYYA | 1081 | CATDPPLFW |
| 4-63 | 799 | RTFSDYTMG | 940 | AAINWSGGYTYYA | 1082 | CATDPPLFW |
| 4-6 | 800 | RTFGDYGMG | 941 | ATINWSGALTHYA | 1083 | CATLPFYDFWSGYYTGYYYMDVW |

TABLE 21-continued

ACE2 Variable Heavy Chain CDRs

| Name | SEQ ID NO | CDRH1 | SEQ ID NO | CDRH2 | SEQ ID NO | CDRH3 |
|---|---|---|---|---|---|---|
| 4-40 | 801 | RTFSDDTMG | 942 | AGVTWSGSSTFYA | 1084 | CATDPPLFW |
| 4-21 | 802 | RTFSDDIMG | 943 | AAISWSGGNTHYA | 1085 | CATDPPLFW |
| 4-64 | 803 | RTFGDYIMG | 944 | AAINWSAGYTAYA | 1086 | CATASPNTGWHFDHW |
| 4-47 | 804 | FTFDDDYVMG | 945 | AAVSGSGDDTYYA | 1087 | CAADRRGLASTRAADYDW |
| 4-65 | 805 | RTFGDYIMG | 946 | AAINWSAGYTAYA | 1088 | CATEPPLSCWHFDLW |
| 4-18 | 806 | RTFGDYIMG | 947 | AAINWSGGYTPYA | 1089 | CATAPPNTGWHFDHW |
| 4-66 | 807 | RTFGDDTMG | 948 | AAINWSAGYTPYA | 1090 | CATDPPLFCCHFDLW |
| 4-36 | 808 | RTFSDDTMG | 949 | AAISWSGGTTRYA | 1091 | CATDPPLFW |
| 4-67 | 809 | RTFSDDTMG | 950 | AAINWSGDSTYYA | 1092 | CATDPPLFW |
| 4-16 | 810 | RTFSDDTMG | 951 | AAINWSGGTTRYA | 1093 | CATDPPLFW |
| 4-11 | 811 | RTFSDDAMG | 952 | AAIHWSGSSTRYA | 1094 | CATDPPLFW |
| 4-68 | 812 | RTFSDDTMG | 953 | GTINWSGGSTYYA | 1095 | CATDPPLFW |
| 4-34 | 813 | RTFGDYIMG | 954 | AAINWSGGYTPYA | 1096 | CATDPPLFW |
| 4-28 | 814 | RTFGDDTMG | 955 | AAINWNGGNTHYA | 1097 | CATDPPLFW |
| 4-69 | 815 | RTFSDDAMG | 956 | AAINWSGGTTRYA | 1098 | CATDPPLFW |
| 4-7 | 816 | RTFGDYIMG | 957 | AAINWSAGYTPYA | 1099 | CATDPPLFWGHVDLW |
| 4-71 | 817 | RTFSDDTMG | 958 | ASINWSGGSTYYA | 1100 | CATDPPLFW |
| 4-23 | 818 | RTFSDDAMG | 959 | AGISWNGGSIYYA | 1101 | CATDPPLFW |
| 4-9 | 819 | FTFDDYEMG | 960 | AAISWRGGTTYYA | 1102 | CAADRRGLASTRAGDYDW |
| 4-72 | 820 | RTFGDDTMG | 961 | AAINWSGGYTPYA | 1103 | CATDPPLFWGHVDLW |
| 4-73 | 821 | RTFSDDAMG | 962 | AAINWSGGSTRYA | 1104 | CATDPPLFW |
| 4-29 | 822 | VTLDDYAMG | 963 | AVINWSGGSTDYA | 1105 | CARGGGWVPSSTSESLNWYFDRW |
| 4-41 | 823 | RTFGDYIMG | 964 | AAINWSGGTTPYA | 1106 | CATDPPLFCCHVDLW |
| 4-74 | 824 | LTFSDDTMG | 965 | AAVSWSGGNTYYA | 1107 | CATDPPLFW |
| 4-75 | 825 | RTFGDDTMG | 966 | AAINWTGGYTPYA | 1108 | CATDPPLFW |
| 4-31 | 826 | RTFGDYIMG | 967 | ATINWTAGYTYYA | 1109 | CATDPPLFCWHFDHW |
| 4-32 | 827 | RTFGDDTMG | 968 | AAINWSGGNTDYA | 1110 | CATDPPLFW |
| 4-15 | 828 | RTFGDYTMG | 969 | AAINWSGGNTYYA | 1111 | CATDPPLFW |
| 4-14 | 829 | RTFSDDTMG | 970 | AGINWSGNGVYYA | 1112 | CATDPPLFW |
| 4-76 | 830 | RTFGDYAMG | 971 | APINWSGGSTYYA | 1113 | CATDPPLFW |

TABLE 21-continued

ACE2 Variable Heavy Chain CDRs

| Name | SEQ ID NO | CDRH1 | SEQ ID NO | CDRH2 | SEQ ID NO | CDRH3 |
|---|---|---|---|---|---|---|
| 4-50 | 831 | GTFSNSGMG | 972 | AVVNWSGRRTYYA | 1114 | CAVPWMDYNRRDW |
| 4-17 | 832 | QLANFASYAMG | 973 | AAITRSGSSTVYA | 1115 | CATTMNPNPRW |
| 4-37 | 833 | RTFSDDIMG | 974 | AAINWTGGSTYYA | 1116 | CATDPPLFW |
| 4-44 | 834 | RTFGDYIMG | 975 | AAINWSAGYTAYA | 1117 | CATARPNTGWHFDHW |
| 4-77 | 835 | RTFSDDTMG | 976 | GSINWSGGSTYYA | 1118 | CATDPPLFW |
| 4-78 | 836 | RTFSDDTMG | 977 | AGMTWSGSSTFYA | 1119 | CATDPPLFW |
| 4-79 | 837 | RTFGDYIMG | 978 | AAINWSGDYTDYA | 1120 | CATDPPLFW |
| 4-8 | 838 | RTFGDYIMG | 979 | GGINWSGGYTYYA | 1121 | CATDPPLFW |
| 4-81 | 839 | RTFSDDTMG | 980 | AAVNWSGGSTYYA | 1122 | CATDPPLFW |
| 4-82 | 840 | RTFGDYAMG | 981 | AAINWSGGYTRYA | 1123 | CATDPPLFW |
| 4-83 | 841 | RTFGDDTMG | 982 | AAINWSGGYTPYA | 1124 | CATDPPLFW |
| 4-35 | 842 | RTFGDYIMG | 983 | AAINWSAGYTAYA | 1125 | CARASPNTGWHFDRW |
| 4-45 | 843 | RTFGDYIMG | 984 | AAINWSGGYTHYA | 1126 | CATDPPLFW |
| 4-84 | 844 | RTFSDDTMG | 985 | AAITWSGGRTRYA | 1127 | CATDRPLFW |
| 4-85 | 845 | RTFGDYIMG | 986 | AAINWSGGYTAYA | 1128 | CATASPNTGWHFDHW |
| 4-86 | 846 | RTFSDDTMG | 987 | AAIHWSGSSTRYA | 1129 | CATDPPLFW |
| 4-87 | 847 | RTFSDYTMG | 988 | AAINWSGGTTYYA | 1130 | CATDPPLFW |
| 4-88 | 848 | RTFGDDTMG | 989 | AAINWSGDNTHYA | 1131 | CATDPPLFW |
| 4-89 | 849 | FAFGDNWIG | 990 | ASISSGGTTAYA | 1132 | CAHRGGWLRPWGYW |
| 4-9 | 850 | RTFSDDAMG | 991 | GRINWSGGNTYYA | 1133 | CATDPPLFW |
| 4-91 | 851 | RTFSDDTMG | 992 | GGISWSGGNTYYA | 1134 | CATDPPLFW |
| 4-92 | 852 | RTFSDDTMG | 993 | AAINWSGGSTYYA | 1135 | CATDPPLFW |
| 4-46 | 853 | RTFGDDTMG | 994 | AAINWSGGYTYYA | 1136 | CATDPPLFW |
| 4-20 | 854 | RTFGDYIMG | 995 | AAINWSADYTAYA | 1137 | CATDPPLFCWHFDHW |
| 4-93 | 855 | RTFSDDAMG | 996 | AAINWSGSSTYYA | 1138 | CATDPPLFW |
| 4-4 | 856 | RTFGDYIMG | 997 | AAINWIAGYTADA | 1139 | CAEPSPNTGWHFDHW |
| 4-2 | 857 | RTFGDDTMG | 998 | AAINWSGGNTPYA | 1140 | CATDPPLFW |
| 4-94 | 858 | RTFSDDTMG | 999 | AAINWSGDNTHYA | 1141 | CATDPPLFW |

TABLE 21-continued

ACE2 Variable Heavy Chain CDRs

| Name | SEQ ID NO | CDRH1 | SEQ ID NO | CDRH2 | SEQ ID NO | CDRH3 |
|---|---|---|---|---|---|---|
| 4-95 | 859 | RTFGDYIMG | 1000 | AAINWSAGYTAYA | 1142 | CATAPPLFCWHFDHW |
| 4-12 | 860 | FTFGDYVMG | 1001 | AAINWNAGYTAYA | 1143 | CAKASPNTGWHFDHW |
| 4-30 | 861 | RTFGDYTMG | 1002 | AAINWTGGYTYYA | 1144 | CATDPPLFW |
| 4-27 | 862 | RTFGDYIMG | 1003 | AAINWSAGYTAYA | 1145 | CARATPNTGWHFDHW |
| 4-22 | 863 | RTFGDYIMG | 1004 | AAINWSGDNTHYA | 1146 | CATDPPLFW |
| 4-96 | 864 | RTFGDYIMG | 1005 | AAINWSAGYTPYA | 1147 | CATDPPLFCCHFDHW |
| 4-97 | 865 | RTFGDYIMG | 1006 | AAINWSAGYTAYA | 1148 | CATAPPNTGWHFDHW |
| 4-98 | 866 | FTWGDYTMG | 1007 | AAINWSGGNTYYA | 1149 | CAADRRGLASTRAADYDW |
| 4-99 | 867 | IPSTLRAMG | 1008 | AAVSSLGPFTRYA | 1150 | CAAKPGWVARDPSQYNW |
| 4-100 | 868 | FSFDDDYVMG | 1009 | AAINWSGGSTYYA | 1151 | CAADRRGLASTRAADYDW |
| 4-101 | 869 | RTFSNAAMG | 1010 | ARILWTGASRSYA | 1152 | CATTENPNPRW |
| 4-102 | 870 | GTFGVYHMG | 1011 | AAINMSGDDSAYA | 1153 | CAILVGPGQVEFDHW |
| 4-103 | 871 | FTFSSYYMG | 1012 | ARISGSTFYA | 1154 | CAALPFVCPSGSYSDYGDEYDW |
| 4-104 | 872 | RTFSGDFMG | 1013 | GRINWSGGNTYYA | 1155 | CPTDPPLFW |
| 4-105 | 873 | STLRDYAMG | 1014 | AAITWSGGSTAYA | 1156 | CASLLAGDRYFDYW |
| 4-106 | 874 | FTFDDYTMG | 1015 | AAITDNGGSKYYA | 1157 | CAADRRGLASTRAADYDW |
| 4-107 | 875 | GTFSSYGMG | 1016 | AAINWSGASTYYA | 1158 | CARDWRDRTWGNSLDYW |
| 4-108 | 876 | FSFDDDYVMG | 1017 | AAISWSEDNTYYA | 1159 | CAADRRGLASTRAADYDW |
| 4-109 | 877 | FSFDDDYVMG | 1018 | AAVSGSGDDTYYA | 1160 | CAADRRGLASTRAADYDW |
| 4-110 | 878 | NIAAINVMG | 1019 | AAISASGRRTDYA | 1161 | CARRVYYYDSSGPPGVTFDIW |
| 4-111 | 879 | IITSRYVMG | 1020 | AAISTGGSTIYA | 1162 | CARQDSSSPYFDYW |
| 4-112 | 880 | FSFDDDYVMG | 1021 | AAISNSGLSTYYA | 1163 | CAADRRGLASTRAADYDW |
| 4-113 | 881 | SISSINVMG | 1022 | ATMRWSTGSTYYA | 1164 | CAQRVRGFFGPLRTTPSWYEW |
| 4-114 | 882 | LTFILYRMG | 1023 | AAINNFGTTKYA | 1165 | CARTHYDFWSGYTSRTPNYFDYW |
| 4-115 | 883 | GTFSVYHMG | 1024 | AAISWGGSTAYA | 1166 | CAAVNTWTSPSFDSW |
| 4-116 | 884 | RAFSTYGMG | 1025 | AGINWSGDTPYYA | 1167 | CAREVGPPPGYFDLW |
| 4-117 | 885 | RTFSDIAMG | 1026 | ASINWGGGNTYYA | 1168 | CAAKGIWDYLGRRDFGDW |

TABLE 21-continued

ACE2 Variable Heavy Chain CDRs

| Name | SEQ ID NO | CDRH1 | SEQ ID NO | CDRH2 | SEQ ID NO | CDRH3 |
|---|---|---|---|---|---|---|
| 4-118 | 886 | RTFSSARMG | 1027 | AAISWSGDNTHYA | 1169 | CATTENPNPRW |
| 4-119 | 887 | FAFSSYAMG | 1028 | ATINGDDYTYYA | 1170 | CVATPGGYGLW |
| 4-120 | 888 | ITFRRHDMG | 1029 | AAIRWSSSSTVYA | 1171 | CAADRGVYGGRWYRTSQYTW |
| 4-121 | 889 | TAASFNPMG | 1030 | AAITSGGSTNYA | 1172 | CAAIAYEEGVYRWDW |
| 4-122 | 890 | NINIINYMG | 1031 | AAIHWNGDSTAYA | 1173 | CASGPPYSNYFAYW |
| 4-123 | 891 | FTFDDYAMG | 1032 | AAISGSGGSTAYA | 1174 | CAKIMGSGRPYFDHW |
| 4-124 | 892 | NIFTRNVMG | 1033 | AAITSSGSTNYA | 1175 | CARPSSDLQGGVDYW |
| 4-125 | 893 | RTFSSIAMG | 1034 | ASINWGGGNTIYA | 1176 | CAAKGIWDYLGRRDFGDW |
| 4-126 | 894 | IPSTLRAMG | 1035 | AAVSSLGPFTRYA | 1177 | CAAKPGWVARDPSEYNW |
| 4-127 | 895 | FTLDDSAMG | 1036 | AAITNGGSTYYA | 1178 | CAREARGSPYFDFW |
| 4-128 | 896 | SISSFNAMG | 1037 | AAIDWDGSTAYA | 1179 | CARGGGYYGSGSFEYW |
| 4-129 | 897 | NIFSDNIIG | 1038 | AYYTSGGSIDYA | 1180 | CARGTAVGRPPPGGMDVW |
| 4-130 | 898 | SISSIGAMG | 1039 | AAISSSGSSTVYA | 1181 | CARVPPGQAYFDSW |
| 4-131 | 899 | FTFDDYGMG | 1040 | ATITWSGDSTYYA | 1182 | CAKGGSWYYDSSGYYGRW |
| 4-132 | 900 | RTFSNYTMG | 1041 | SAISWSTGSTYYA | 1183 | CAADRYGPPWYDW |
| 4-133 | 901 | STNYMG | 1042 | AAISMSGDDTIYA | 1184 | CARIGLRGRYFDLW |
| 4-134 | 902 | GTFSSVGMG | 1043 | AVINWSGARTYYA | 1185 | CAVPWMDYNRRDW |
| 4-135 | 903 | RIFTNTAMG | 1044 | AAINWGGSTAYA | 1186 | CARTSGSYSFDYW |
| 4-136 | 904 | EEFSDHWMG | 1045 | GAIHWSGGRTYYA | 1187 | CAADRRGLASTRAADYDW |
| 4-137 | 905 | RTFSSIAMG | 1046 | AAINWSGARTAYA | 1188 | CAAKGIWDYLGRRDFGDW |
| 4-138 | 906 | STSSLRTMG | 1047 | AAISSRDGSTIYA | 1189 | CARDDSSPYFDYW |
| 4-139 | 907 | GGTFGSYAMG | 1048 | AAISIASGASGGTTNYA | 1190 | CATTMNPNPRW |
| 4-140 | 908 | RTFSNAAMG | 1049 | ARITWNGGSTFYA | 1191 | CATTENPNPRW |
| 4-141 | 909 | IILSDNAMG | 1050 | AAISWLGESTYYA | 1192 | CAADRRGLASTRAADYDW |
| 4-142 | 910 | RTFGDYIMG | 1051 | AAINWNGGYTAYA | 1193 | CATTSPNTGWHYYRW |
| 4-143 | 911 | FNFNWYPMG | 1052 | AAISWTGVSTYTAYA | 1194 | CARWGPGPAGGSPGLVGFDYW |
| 4-144 | 912 | SIRSVSVMG | 1053 | AAISWSGVGTAYA | 1195 | CAAYQRGWGDW |
| 4-145 | 913 | MTFRLYAMG | 1054 | GAINWLSESTYYA | 1196 | CAAKPGWVARDPSEYNW |
| 4-146 | 914 | RTFSDDAMG | 1055 | AAINWSGGSTYYA | 1197 | CATDPPLFW |
| 4-147 | 915 | GTFSVYAMG | 1056 | AAISMSGDDAAYA | 1198 | CAKISKDDGGKPRGAFFDSW |

TABLE 21-continued

ACE2 Variable Heavy Chain CDRs

| Name | SEQ ID NO | CDRH1 | SEQ ID NO | CDRH2 | SEQ ID NO | CDRH3 |
|---|---|---|---|---|---|---|
| 4-148 | 916 | FALGYYAMG | 1057 | AAISSRDGSTAYA | 1199 | CARLATGPQAYFHHW |
| 4-149 | 917 | FNLDDYAMG | 1058 | AAISWDGGATAYA | 1200 | CARVGRGTTAFDSW |
| 4-150 | 918 | NTFSGGFMG | 1059 | ASIRSGARTYYA | 1201 | CAQRVRGFFGPLRTTPSWYEW |
| 4-151 | 919 | SIRSINIMG | 1060 | AAISWSGGSTVYA | 1202 | CASLLAGDRYFDYW |

TABLE 22

ACE2 Variant Sequences Variable Heavy Chain

| Name | SEQ ID | Amino Acid Sequence |
|---|---|---|
| 4-51 | 1203 | EVQLVESGGGLVQPGGSLRLSCAASGPGTAIMGWFRQAPGKEREFVARISTSGGSTKYADSVKGRFTISADNSKNTAYLQMNSLKPEDTAVYYCARTTVTTPPLIWGQGTLVTVSS |
| 4-52 | 1204 | EVQLVESGGGLVQPGGSLRLSCAASGRSFSNSVMGWFRQAPGKEREFVARITWNGGSTYYADSVKGRFTISADNSKNTAYLQMNSLKPEDTAVYYCATTENPNPRWGQGTLVTVSS |
| 4-53 | 1205 | EVQLVESGGGLVQPGGSLRLSCAASGRTFGDDTMGWFRQAPGKEREFVAAVSWSGSGVYYADSVKGRFTITADNSKNTAYLQMNSLKPENTAVYYCATDPPLFWGQGTLVTVSS |
| 4-54 | 1206 | EVQLVESGGGLVQPGGSLRLSCAASGRTFSDARMGWFRQAPGKEREFVGAVSWSGGTTVYADSVKGRFTISADNSKNTAYLQMNSLKPEDTAVYYCATTEDPYPRWGQGTLVTVSS |
| 4-49 | 1207 | EVQLVESGGGLVQPGGSLRLSCAASGRTFGDYIMGWFRQAPGKERESVAAINWSAGYTAYADSVKGRFTISADNSKNTAYLQMNSLKPEDTAVYYCARASPNTGWHFDHWGQGTLVTVSS |
| 4-55 | 1208 | EVQLVESGGGLVQPGGSLRLSCAASGSGLSINAMGWFRQAPGKERESVAAISWSGGSTYTAYADSVKGRFTISADNSKNTAYLQMNSLKPEDTAVYYCAAYQAGWGDWGQGTLVTVSS |
| 4-39 | 1209 | EVQLVESGGGLVQPGGSLRLSCAASGRTFSNAAMGWFRQAPGKEREFVARILWTGASRNYADSVKGRFTISADNSKNTAYLQMNSLKPEDTAVYYCATTENPNPRWGQGTLVTVSS |
| 4-56 | 1210 | EVQLVESGGGLVQPGGSLRLSCAASGFSLDYYGMGWFRQAPGKERESVAAISWNGDFTAYADSVKGRFTISADNSKNTAYLQMNSLKPEDTAVYYCAKRANPTGAYFDYWGQGTLVTVSS |
| 4-33 | 1211 | EVQLVESGGGLVQPGGSLRLSCAASGFTFSRHDMGWFRQAPGKEREFVAGINWESGSTNYADSVKGRFTISADNSKNTAYLQMNSLKPEDTAVYYCAADRGVYGGRWYRTSQYTWGQGTLVTVSS |
| 4-57 | 1212 | EVQLVESGGGLVQPGGSLRLSCAASGLTFRNYAMGWFRQAPGKEREFVAAIGSGGYTDYADSVKGRFTISADNSKNTAYLQMNSLKPEDTAVYYCAVKPGWVARDPSQYNWGQGTLVTVSS |
| 4-25 | 1213 | EVQLVESGGGLVQPGGSLRLSCAASGGTFSRYAMGWFRQAPGKEREWVSAVDSGGSTYYADSVKGRFTISADNSKNTAYLQMNSLKPEDTAVYYCAASPSLRSAWQWGQGTLVTVSS |
| 4-58 | 1214 | EVQLVESGGGLVQPGGSLRLSCAASGFTLDYYDMGWFRQAPGKEREFVAAVTWSGGSTYYADSVKGRFTISADNSKNTAYLQMNSLKPEDTAVYYCAADRRGLASTRAADYDWGQGTLVTVSS |
| 4-59 | 1215 | EVQLVESGGGLVQPGGSLRLSCAASGRTFGDYIMGWFRQAPGKEREFVAAINWSAGYTPYADSVKGRFTISADNSKNTAYLQMNSLKPEDTAVYYCATAPPLFCWHFDLWGQGTLVTVSS |

TABLE 22-continued

ACE2 Variant Sequences Variable Heavy Chain

| Name | SEQ ID | Amino Acid Sequence |
|---|---|---|
| 4-6 | 1216 | EVQLVESGGGLVQPGGSLRLSCAASGRTFGDDIMGWFRQAPGKEREFVAAIHWSAGYTRYADSVKGRFTISADNSKNTAYLQMNSLKPEDTAVYYCATDPPLFWGHVDLWGQGTLVTVSS |
| 4-61 | 1217 | EVQLVESGGGLVQPGGSLRLSCAASGRTFGDYIMGWFRQAPGKEREIVAAINWSADYTPYADSVKGRFTISADNSKNTAYLQMNSLKPEDTAVYYCATAPPNTGWHFDHWGQGTLVTVSS |
| 4-3 | 1218 | EVQLVESGGGLVQPGGSLRLSCAASGRTFGDYIMGWFRQAPGKEREIVAAINWSAGYTAYADSVKGRFTISADNSKNTAYLQMNSLKPEDTAVYYCATATPNTGWHFDHWGQGTLVTVSS |
| 4-62 | 1219 | EVQLVESGGGLVQPGGSLRLSCAASGRTFSDDTMGWFRQAPGKEREFVAAINWSGGSTDYADSVKGRFTISADNSKNTAYLQMNSLKPEDTAVYYCATDPPLFWGQGTLVTVSS |
| 4-43 | 1220 | EVQLVESGGGLVQPGGSLRLSCAASGRTFGDDTMGWFRQAPGKEREFVAGINWSGGNTYYADSVKGRFTISADNSKNTAYLQMNSLKPEDTAVYYCATDPPLFWGQGTLVTVSS |
| 4-5 | 1221 | EVQLVESGGGLVQPGGSLRLSCAASGRTFGDYIMGWFRQAPGKEREFVAAINWTGGYTSYADSVKGRFTISADNSKNTAYLQMNSLKPEDTAVYYCATDPPLFWGQGTLVTVSS |
| 4-42 | 1222 | EVQLVESGGGLVQPGGSLRLSCAASGRTFGDDTMGWFRQAPGKERECVAAINWSGGNTYYADSVKGRFTISADNSKNTAYLQMNSLKPEDTAVYYCATDPPLFWGQGTLVTVSS |
| 4-63 | 1223 | EVQLVESGGGLVQPGGSLRLSCAASGRTFSDYTMGWFRQAPGKEREFVAAINWSGGYTYYADSVKGRFTISADNSKNTAYLQMNSLKPEDTAVYYCATDPPLFWGQGTLVTVSS |
| 4-6 | 1224 | EVQLVESGGGLVQPGGSLRLSCAASGRTFGDYGMGWFRQAPGKEREFVATINWSGALTHYADSVKGRFTISADNSKNTAYLQMNSLKPEDTAVYYCATLPFYDFWSGYYTGYYYMDVWGQGTLVTVSS |
| 4-40 | 1225 | EVQLVESGGGLVQPGGSLRLSCAASGRTFSDDTMGWFRQAPGKEREFLAGVTWSGSSTFYADSVKGRFTISADNSKNTAYLQMNSLKPEDTAVYYCATDPPLFWGQGTLVTVSS |
| 4-21 | 1226 | EVQLVESGGGLVQPGGSLRLSCAASGRTFSDDIMGWFRQAPGKEREFVAAISWSGGNTHYADSVKGRFTISADNSKNTAYLQMNSLKPEDTAVYYCATDPPLFWGQGTLVTVSS |
| 4-64 | 1227 | EVQLVESGGGLVQPGGSLRLSCAASGRTFGDYIMGWFRQAPGKERESVAAINWSAGYTAYADSVKGRFTISADNSKNTAYLQMNSLKPEDTAVYYCATASPNTGWHFDHWGQGTLVTVSS |
| 4-47 | 1228 | EVQLVESGGGLVQPGGSLRLSCAASGFTFDDDYVMGWFRQAPGKEREFVAAVSGSGDDTYYADSVKGRFTISADNSKNTAYLQMNSLKPEDTAVYYCAADRRGLASTRAADYDWGQGTLVTVSS |
| 4-65 | 1229 | EVQLVESGGGLVQPGGSLRLSCAASGRTFGDYIMGWFRQAPGKEREFVAAINWSAGYTAYADSVKGRFTISADNSKNTAYLQMNSLKPEDTAVYYCATEPPLSCWHFDLWGQGTLVTVSS |
| 4-18 | 1230 | EVQLVESGGGLVQPGGSLRLSCAASGRTFGDYIMGWFRQAPGKEREIVAAINWSGGYTPYADSVKGRFTISADNSKNTAYLQMNSLKPEDTAVYYCATAPPNTGWHFDHWGQGTLVTVSS |
| 4-66 | 1231 | EVQLVESGGGLVQPGGSLRLSCAASGRTFGDDTMGWFRQAPGKEREIVAAINWSAGYTPYADSVKGRFTISADNSKNTAYLQMNSLKPEDTAVYYCATDPPLFCCHFDLWGQGTLVTVSS |
| 4-36 | 1232 | EVQLVESGGGLVQPGGSLRLSCAASGRTFSDDTMGWFRQAPGKEREFVAAISWSGGTTRYADSVKGRFTISADNSKNTAYLQMNSLKPEDTAVYYCATDPPLFWGQGTLVTVSS |
| 4-67 | 1233 | EVQLVESGGGLVQPGGSLRLSCAASGRTFSDDTMGWFRQAPGKEREFVAAINWSGDSTYYADSVKGRFTISADNSKNTAYLQMNSLKPEDTAVYYCATDPPLFWGQGTLVTVSS |
| 4-16 | 1234 | EVQLVESGGGLVQPGGSLRLSCAASGRTFSDDTMGWFRQAPGKEREFVAAINWSGGTTRYADSVKGRFTISADNSKNTAYLQMNSLKPEDTAVYYCATDPPLFWGQGTLVTVSS |

TABLE 22-continued

ACE2 Variant Sequences Variable Heavy Chain

| Name | SEQ ID | Amino Acid Sequence |
|---|---|---|
| 4-11 | 1235 | EVQLVESGGGLVQPGGSLRLSCAASGRTFSDDAMGWFRQAPGKEREFVAAIH WSGSSTRYADSVKGRFTISADNSKNTAYLQMNSLKPEDTAVYYCATDPPLFW GQGTLVTVSS |
| 4-68 | 1236 | EVQLVESGGGLVQPGGSLRLSCAASGRTFSDDTMGWFRQAPGKERELVGTIN WSGGSTYYADSVKGRFTISADNSKNTAYLQMNSLKPEDTAVYYCATDPPLF WGQGTLVTVSS |
| 4-34 | 1237 | EVQLVESGGGLVQPGGSLRLSCAASGRTFGDYIMGWFRQAPGKEREFVAAIN WSGGYTPYADSVKGRFTISADNSKNTAYLQMNSLKPEDTAVYYCATDPPLF WGQGTLVTVSS |
| 4-28 | 1238 | EVQLVESGGGLVQPGGSLRLSCAASGRTFGDDTMGWFRQAPGKERELVAAIN WNGGNTHYADSVKGRFTISADNSKNTAYLQMNSLKPEDTAVYYCATDPPLF WGQGTLVTVSS |
| 4-69 | 1239 | EVQLVESGGGLVQPGGSLRLSCAASGRTFSDDAMGWFRQAPGKEREFVAAIN WSGGTTRYADSVKGRFTISADNSKNTAYLQMNSLKPEDTAVYYCATDPPLF WGQGTLVTVSS |
| 4-7 | 1240 | EVQLVESGGGLVQPGGSLRLSCAASGRTFGDYIMGWFRQAPGKERESVAAIN WSAGYTPYADSVKGRFTISADNSKNTAYLQMNSLKPEDTAVYYCATDPPLF WGHVDLWGQGTLVTVSS |
| 4-71 | 1241 | EVQLVESGGGLVQPGGSLRLSCAASGRTFSDDTMGWFRQAPGKEREWVASIN WSGGSTYYADSVKGRFTISADNSKNTAYLQMNSLKPEDTAVYYCATDPPLF WGQGTLVTVSS |
| 4-23 | 1242 | EVQLVESGGGLVQPGGSLRLSCAASGRTFSDDAMGWFRQAPGKEREFVAGIS WNGGSIYYADSVKGRFTISADNSKNTAYLQMNSLKPEDTAVYYCATDPPLFW GQGTLVTVSS |
| 4-9 | 1243 | EVQLVESGGGLVQPGGSLRLSCAASGFTFDDYEMGWFRQAPGKEREFVAAIS WRGGTTYYADSVKGRFTISADNSKNTAYLQMNSLKPEDTAVYYCAADRRGL ASTRAGDYDWGQGTLVTVSS |
| 4-72 | 1244 | EVQLVESGGGLVQPGGSLRLSCAASGRTFGDDTMGWFRQAPGKEREFVAAIN WSGGYTPYADSVKGRFTISADNSKNTAYLQMNSLKPEDTAVYYCATDPPLF WGHVDLWGQGTLVTVSS |
| 4-73 | 1245 | EVQLVESGGGLVQPGGSLRLSCAASGRTFSDDAMGWFRQAPGKEREFVAAIN WSGGSTRYADSVKGRFTISADNSKNTAYLQMNSLKPEDTAVYYCATDPPLFW GQGTLVTVSS |
| 4-29 | 1246 | EVQLVESGGGLVQPGGSLRLSCAASGVTLDDYAMGWFRQAPGKEREFVAVI NWSGGSTDYADSVKGRFTISADNSKNTAYLQMNSLKPEDTAVYYCARGGGW VPSSTSESLNWYFDRWGQGTLVTVSS |
| 4-41 | 1247 | EVQLVESGGGLVQPGGSLRLSCAASGRTFGDYIMGWFRQAPGKERESVAAIN WSGGTTPYADSVKGRFTISADNSKNTAYLQMNSLKPEDTAVYYCATDPPLFC CHVDLWGQGTLVTVSS |
| 4-74 | 1248 | EVQLVESGGGLVQPGGSLRLSCAASGLTFSDDTMGWFRQAPGKEREFVAAVS WSGGNTYYADSVKGRFTISADNSKNTAYLQMNSLKPEDTAVYYCATDPPLF WGQGTLVTVSS |
| 4-75 | 1249 | EVQLVESGGGLVQPGGSLRLSCAASGRTFGDDTMGWFRQAPGKEREFVAAIN WTGGYTPYADSVKGRFTISADNSKNTAYLQMNSLKPEDTAVYYCATDPPLF WGQGTLVTVSS |
| 4-31 | 1250 | EVQLVESGGGLVQPGGSLRLSCAASGRTFGDYIMGWFRQAPGKEREFVATIN WTAGYTYYADSVKGRFTISADNSKNTAYLQMNSLKPEDTAVYYCATDPPLFC WHFDHWGQGTLVTVSS |
| 4-32 | 1251 | EVQLVESGGGLVQPGGSLRLSCAASGRTFGDDTMGWFRQAPGKEREFVAAIN WSGGNTDYADSVKGRFTISADNSKNTAYLQMNSLKPEDTAVYYCATDPPLF WGQGTLVTVSS |
| 4-15 | 1252 | EVQLVESGGGLVQPGGSLRLSCAASGRTFGDYTMGWFRQAPGKEREFVAAIN WSGGNTYYADSVKGRFTISADNSKNTAYLQMNSLKPEDTAVYYCATDPPLF WGQGTLVTVSS |

TABLE 22-continued

ACE2 Variant Sequences Variable Heavy Chain

| Name | SEQ ID | Amino Acid Sequence |
|---|---|---|
| 4-14 | 1253 | EVQLVESGGGLVQPGGSLRLSCAASGRTFSDDTMGWFRQAPGKEREFVAGIN WSGNGVYYADSVKGRFTISADNSKNTAYLQMNSLKPEDTAVYYCATDPPLF WGQGTLVTVSS |
| 4-76 | 1254 | EVQLVESGGGLVQPGGSLRLSCAASGRTFGDYAMGWFRQAPGKERELVAPIN WSGGSTYYADSVKGRFTISADNSKNTAYLQMNSLKPEDTAVYYCATDPPLF WGQGTLVTVSS |
| 4-50 | 1255 | EVQLVESGGGLVQPGGSLRLSCAASGGTFSNSGMGWFRQAPGKERELVAVV NWSGRRTYYADSVKGRFTISADNSKNTAYLQMNSLKPEDTAVYYCAVPWM DYNRRDWGQGTLVTVSS |
| 4-17 | 1256 | EVQLVESGGGLVQPGGSLRLSCAASGQLANFASYAMGWFRQAPGKEREFVA AITRSGSSTVYADSVKGRFTISADNSKNTAYLQMNSLKPEDTAVYYCATTMN PNPRWGQGTLVTVSS |
| 4-37 | 1257 | EVQLVESGGGLVQPGGSLRLSCAASGRTFSDDIMGWFRQAPGKEREFVAAIN WTGGSTYYADSVKGRFTISADNSKNTAYLQMNSLKPEDTAVYYCATDPPLF WGQGTLVTVSS |
| 4-44 | 1258 | EVQLVESGGGLVQPGGSLRLSCAASGRTFGDYIMGWFRQAPGKEREIVAAIN WSAGYTAYADSVKGRFTISADNSKNTAYLQMNSLKPEDTAVYYCATARPNT GWHFDHWGQGTLVTVSS |
| 4-77 | 1259 | EVQLVESGGGLVQPGGSLRLSCAASGRTFSDDTMGWFRQAPGKEREWVGSIN WSGGSTYYADSVKGRFTISADNSKNTAYLQMNSLKPEDTAVYYCATDPPLF WGQGTLVTVSS |
| 4-78 | 1260 | EVQLVESGGGLVQPGGSLRLSCAASGRTFSDDTMGWFRQAPGKEREFVAGM TWSGSSTFYADSVKGRFTISADNSKNTAYLQMNSLKPEDTAVYYCATDPPLF WGQGTLVTVSS |
| 4-79 | 1261 | EVQLVESGGGLVQPGGSLRLSCAASGRTFGDYIMGWFRQAPGKERECVAAIN WSGDYTDYADSVKGRFTISADNSKNTAYLQMNSLKPEDTAVYYCATDPPLF WGQGTLVTVSS |
| 4-8 | 1262 | EVQLVESGGGLVQPGGSLRLSCAASGRTFGDYIMGWFRQAPGKEREFVGGIN WSGGYTYYADSVKGRFTISADNSKNTAYLQMNSLKPEDTAVYYCATDPPLF WGQGTLVTVSS |
| 4-81 | 1263 | EVQLVESGGGLVQPGGSLRLSCAASGRTFSDDTMGWFRQAPGKEREFVAAV NWSGGSTYYADSVKGRFTISADNSKNTAYLQMNSLKPEDTAVYYCATDPPLF WGQGTLVTVSS |
| 4-82 | 1264 | EVQLVESGGGLVQPGGSLRLSCAASGRTFGDYAMGWFRQAPGKEREFVAAIN WSGGYTRYADSVKGRFTISADNSKNTAYLQMNSLKPEDTAVYYCATDPPLF WGQGTLVTVSS |
| 4-83 | 1265 | EVQLVESGGGLVQPGGSLRLSCAASGRTFGDDTMGWFRQAPGKEREFVAAIN WSGGYTPYADSVKGRFTISADNSKNTAYLQMNSLKPEDTAVYYCATDPPLF WGQGTLVTVSS |
| 4-35 | 1266 | EVQLVESGGGLVQPGGSLRLSCAASGRTFGDYIMGWFRQAPGKERESVAAIN WSAGYTAYADSVKGRFTISADNSKNTAYLQMNSLKPEDTAVYYCARASPNT GWHFDRWGQGTLVTVSS |
| 4-45 | 1267 | EVQLVESGGGLVQPGGSLRLSCAASGRTFGDYIMGWFRQAPGKEREFVAAIN WSGGYTHYADSVKGRFTISADNSKNTAYLQMNSLKPEDTAVYYCATDPPLF WGQGTLVTVSS |
| 4-84 | 1268 | EVQLVESGGGLVQPGGSLRLSCAASGRTFSDDTMGWFRQAPGKEREFVAAIT WSGGRTRYADSVKGRFTISADNSKNTAYLQMNSLKPEDTAVYYCATDRPLF WGQGTLVTVSS |
| 4-85 | 1269 | EVQLVESGGGLVQPGGSLRLSCAASGRTFGDYIMGWFRQAPGKERESVAAIN WSGGYTAYADSVKGRFTISADNSKNTAYLQMNSLKPEDTAVYYCATASPNT GWHFDHWGQGTLVTVSS |
| 4-86 | 1270 | EVQLVESGGGLVQPGGSLRLSCAASGRTFSDDTMGWFRQAPGKEREFVAAIH WSGSSTRYADSVKGRFTISADNSKNTAYLQMNSLKPEDTAVYYCATDPPLFW GQGTLVTVSS |

TABLE 22-continued

ACE2 Variant Sequences Variable Heavy Chain

| Name | SEQ ID | Amino Acid Sequence |
|---|---|---|
| 4-87 | 1271 | EVQLVESGGGLVQPGGSLRLSCAASGRTFSDYTMGWFRQAPGKEREWVAAI<br>NWSGGTTYYADSVKGRFTISADNSKNTAYLQMNSLKPEDTAVYYCATDPPLF<br>WGQGTLVTVSS |
| 4-88 | 1272 | EVQLVESGGGLVQPGGSLRLSCAASGRTFGDDTMGWFRQAPGKEREFVAAIN<br>WSGDNTHYADSVKGRFTISADNSKNTAYLQMNSLKPEDTAVYYCATDPPLF<br>WGQGTLVTVSS |
| 4-89 | 1273 | EVQLVESGGGLVQPGGSLRLSCAASGFAFGDNWIGWFRQAPGKEREWVASIS<br>SGGTTAYADNVKGRFTIIADNSKNTAYLQMNSLKPEDTAVYYCAHRGGWLR<br>PWGYWGQGTLVTVSS |
| 4-9 | 1274 | EVQLVESGGGLVQPGGSLRLSCAASGRTFSDDAMGWFRQAPGKEREFVGRIN<br>WSGGNTYYADSVKGRFTISADNSKNTAYLQMNSLKPEDTAVYYCATDPPLF<br>WGQGTLVTVSS |
| 4-91 | 1275 | EVQLVESGGGLVQPGGSLRLSCAASGRTFSDDTMGWFRQAPGKEREFVGGIS<br>WSGGNTYYADSVKGRFTISADNSKNTAYLQMNSLKPEDTAVYYCATDPPLF<br>WGQGTLVTVSS |
| 4-92 | 1276 | EVQLVESGGGLVQPGGSLRLSCAASGRTFSDDTMGWFRQAPGKEREFVAAIN<br>WSGGSTYYADSVKGRFTISADNSKNTAYLQMNSLKPEDTAVYYCATDPPLF<br>WGQGTLVTVSS |
| 4-46 | 1277 | EVQLVESGGGLVQPGGSLRLSCAASGRTFGDDTMGWFRQAPGKEREFVAAIN<br>WSGGYTYYADSVKGRFTISADNSKNTAYLQMNSLKPEDTAVYYCATDPPLF<br>WGQGTLVTVSS |
| 4-20 | 1278 | EVQLVESGGGLVQPGGSLRLSCAASGRTFGDYIMGWFRQAPGKEREFVAAIN<br>WSADYTAYADSVKGRFTISADNSKNTAYLQMNSLKPEDTAVYYCATDPPLFC<br>WHFDHWGQGTLVTVSS |
| 4-93 | 1279 | EVQLVESGGGLVQPGGSLRLSCAASGRTFSDDAMGWFRQAPGKEREFVAAIN<br>WSGSSTYYADSVKGRFTISADNSKNTAYLQMNSLKPEDTAVYYCATDPPLFW<br>GQGTLVTVSS |
| 4-4 | 1280 | EVQLVESGGGLVQPGGSLRLSCAASGRTFGDYIMGWFRQAPGKEREMVAAIN<br>WIAGYTADADSVRRLFTITADNNKNTAHLMMNLLKPENTAVYYCAEPSPNT<br>GWHFDHWGQGTLVTVSS |
| 4-2 | 1281 | EVQLVESGGGLVQPGGSLRLSCAASGRTFGDDTMGWFRQAPGKEREFVAAIN<br>WSGGNTPYADSVKGRFTISADNSKNTAYLQMNSLKPEDTAVYYCATDPPLF<br>WGQGTLVTVSS |
| 4-94 | 1282 | EVQLVESGGGLVQPGGSLRLSCAASGRTFSDDTMGWFRQAPGKEREFVAAIN<br>WSGDNTHYADSVKGRFTISADNSKNTAYLQMNSLKPEDTAVYYCATDPPLF<br>WGQGTLVTVSS |
| 4-95 | 1283 | EVQLVESGGGLVQPGGSLRLSCAASGRTFGDYIMGWFRQAPGKEREIVAAIN<br>WSAGYTAYADSVKGRFTISADNSKNTAYLQMNSLKPEDTAVYYCATAPPLFC<br>WHFDHWGQGTLVTVSS |
| 4-12 | 1284 | EVQLVESGGGLVQPGGSLRLSCAASGFTFGDYVMGWFRQAPGKEREIVAAIN<br>WNAGYTAYADSVRGLFTITADNSKNTAYLQMNSLKPEDTAVYYCAKASPNT<br>GWHFDHWGQGTLVTVSS |
| 4-30 | 1285 | EVQLVESGGGLVQPGGSLRLSCAASGRTFGDYTMGWFRQAPGKEREFVAAIN<br>WTGGYTYYADSVKGRFTISADNSKNTAYLQMNSLKPEDTAVYYCATDPPLF<br>WGQGTLVTVSS |
| 4-27 | 1286 | EVQLVESGGGLVQPGGSLRLSCAASGRTFGDYIMGWFRQAPGKEREIVAAIN<br>WSAGYTAYADSVKGLFTITADNSKNTAYLQMNILKPEDTAVYYCARATPNT<br>GWHFDHWGQGTLVTVSS |
| 4-22 | 1287 | EVQLVESGGGLVQPGGSLRLSCAASGRTFGDYIMGWFRQAPGKEREFVAAIN<br>WSGDNTHYADSVKGRFTISADNSKNTAYLQMNSLKPEDTAVYYCATDPPLF<br>WGQGTLVTVSS |
| 4-96 | 1288 | EVQLVESGGGLVQPGGSLRLSCAASGRTFGDYIMGWFRQAPGKEREIVAAIN<br>WSAGYTPYADSVKGRFTISADNSKNTAYLQMNSLKPEDTAVYYCATDPPLFC<br>CHFDHWGQGTLVTVSS |

TABLE 22-continued

ACE2 Variant Sequences Variable Heavy Chain

| Name | SEQ ID | Amino Acid Sequence |
|---|---|---|
| 4-97 | 1289 | EVQLVESGGGLVQPGGSLRLSCAASGRTFGDYIMGWFRQAPGKERESVAAIN WSAGYTAYADSVKGRFTISADNSKNTAYLQMNSLKPEDTAVYYCATAPPNT GWHFDHWGQGTLVTVSS |
| 4-98 | 1290 | EVQLVESGGGLVQPGGSLRLSCAASGFTWGDYTMGWFRQAPGKEREFVAAI NWSGGNTYYADSVKGRFTISADNSKNTAYLQMNSLKPEDTAVYYCAADRRG LASTRAADYDWGQGTLVTVSS |
| 4-99 | 1291 | EVQLVESGGGLVQPGGSLRLSCAASGIPSTLRAMGWFRQAPGKEREFVAAVS SLGPFTRYADSVKGRFTISADNSKNTAYLQMNSLKPEDTAVYYCAAKPGWV ARDPSQYNWGQGTLVTVSS |
| 4-100 | 1292 | EVQLVESGGGLVQPGGSLRLSCAASGFSFDDDYVMGWFRQAPGKEREFVAAI NWSGGSTYYADSVKGRFTISADNSKNTAYLQMNSLKPEDTAVYYCAADRRG LASTRAADYDWGQGTLVTVSS |
| 4-101 | 1293 | EVQLVESGGGLVQPGGSLRLSCAASGRTFSNAAMGWFRQAPGKEREFVARIL WTGASRSYADSVKGRFTISADNSKNTAYLQMNSLKPEDTAVYYCATTENPNP RWGQGTLVTVSS |
| 4-102 | 1294 | EVQLVESGGGLVQPGGSLRLSCAASGGTFGVYHMGWFRQAPGKEREGVAAI NMSGDDSAYADSVKGRFTISADNSKNTAYLQMNSLKPEDTAVYYCAILVGPG QVEFDHWGQGTLVTVSS |
| 4-103 | 1295 | EVQLVESGGGLVQPGGSLRLSCAASGFTFSSYYMGWFRQAPGKEREFVARI-- SGSTFYADSVKGRFTISADNSKNTAYLQMNSLKPEDTAVYYCAALPFVCPSGS YSDYGDEYDWGQGTLVTVSS |
| 4-104 | 1296 | EVQLVESGGGLVQPGGSLRLSCAASGRTFSGDFMGWFRQAPGKEREFVGRIN WSGGNTYYADSVRGLFTITADNNKNTAYLMMNLLKPEDTAVYYCPTDPPLF WGLGTLVTWSS |
| 4-105 | 1297 | EVQLVESGGGLVQPGGSLRLSCAASGSTLRDYAMGWFRQAPGKERESVAAIT WSGGSTAYADSVKGRFTISADNSKNTAYLQMNSLKPEDTAVYYCASLLAGD RYFDYWGQGTLVTVSS |
| 4-106 | 1298 | EVQLVESGGGLVQPGGSLRLSCAASGFTFDDYTMGWFRQAPGKEREFVAAIT DNGGSKYYADSVKGRFTISADNSKNTAYLQMNSLKPEDTAVYYCAADRRGL ASTRAADYDWGQGTLVTVSS |
| 4-107 | 1299 | EVQLVESGGGLVQPGGSLRLSCAASGGTFSSYGMGWFRQAPGKEREFVAAIN WSGASTYYADSVKGRFTISADNSKNTAYLQMNSLKPEDTAVYYCARDWRDR TWGNSLDYWGQGTLVTVSS |
| 4-108 | 1300 | EVQLVESGGGLVQPGGSLRLSCAASGFSFDDDYVMGWFRQAPGKEREFVAAI SWSEDNTYYADSVKGRFTISADNSKNTAYLQMNSLKPEDTAVYYCAADRRG LASTRAADYDWGQGTLVTVSS |
| 4-109 | 1301 | EVQLVESGGGLVQPGGSLRLSCAASGFSFDDDYVMGWFRQAPGKEREFVAA VSGSGDDTYYADSVKGRFTISADNSKNTAYLQMNSLKPEDTAVYYCAADRR GLASTRAADYDWGQGTLVTVSS |
| 4-110 | 1302 | EVQLVESGGGLVQPGGSLRLSCAASGNIAAINVMGWFRQAPGKEREFVAAIS ASGRRTDYADSVKGRFTISADNSKNTAYLQMNSLKPEDTAVYYCARRVYYY DSSGPPGVTFDIWGQGTLVTVSS |
| 4-111 | 1303 | EVQLVESGGGLVQPGGSLRLSCAASGIITSRYVMGWFRQAPGKEREGVAAIST GGSTIYADSVKGRFTISADNSKNTAYLQMNSLKPEDTAVYYCARQDSSSPYFD YWGQGTLVTVSS |
| 4-112 | 1304 | EVQLVESGGGLVQPGGSLRLSCAASGFSFDDDYVMGWFRQAPGKEREFVAAI SNSGLSTYYADSVKGRFTISADNSKNTAYLQMNSLKPEDTAVYYCAADRRGL ASTRAADYDWGQGTLVTVSS |
| 4-113 | 1305 | EVQLVESGGGLVQPGGSLRLSCAASGSISSINVMGWFRQAPGKEREFVATMR WSTGSTYYADSVKGRFTISADNSKNTAYLQMNSLKPEDTAVYYCAQRVRGFF GPLRTTPSWYEWGQGTLVTVSS |
| 4-114 | 1306 | EVQLVESGGGLVQPGGSLRLSCAASGLTFILYRMGWFRQAPGKEREFVAAIN NFGTTKYADSVKGRFTISADNSKNTAYLQMNSLKPEDTAVYYCARTHYDFW SGYTSRTPNYFDYWGQGTLVTVSS |

TABLE 22-continued

ACE2 Variant Sequences Variable Heavy Chain

| Name | SEQ ID | Amino Acid Sequence |
|---|---|---|
| 4-115 | 1307 | EVQLVESGGGLVQPGGSLRLSCAASGGTFSVYHMGWFRQAPGKEREPVAAIS WSGGSTAYADSVKGRFTISADNSKNTAYLQMNSLKPEDTAVYYCAAVNTWT SPSFDSWGQGTLVTVSS |
| 4-116 | 1308 | EVQLVESGGGLVQPGGSLRLSCAASGRAFSTYGMGWFRQAPGKEREFVAGIN WSGDTPYYADSVKGRFTISADNSKNTAYLQMNSLKPEDTAVYYCAREVGPPP GYFDLWGQGTLVTVSS |
| 4-117 | 1309 | EVQLVESGGGLVQPGGSLRLSCAASGRTFSDIAMGWFRQAPGKEREFVASIN WGGGNTYYADSVKGRFTISADNSKNTAYLQMNSLKPEDTAVYYCAAKGIWD YLGRRDFGDWGQGTLVTVSS |
| 4-118 | 1310 | EVQLVESGGGLVQPGGSLRLSCAASGRTFSSARMGWFRQAPGKEREFVAAIS WSGDNTHYADSVKGRFTISADNSKNTAYLQMNSLKPEDTAVYYCATTENPN PRWGQGTLVTVSS |
| 4-119 | 1311 | EVQLVESGGGLVQPGGSLRLSCAASGFAFSSYAMGWFRQAPGKEREWVATIN GDDYTYYADSVKGRFTISADNSKNTAYLQMNSLKPEDTAVYYCVATPGGYG LWGQGTLVTVSS |
| 4-120 | 1312 | EVQLVESGGGLVQPGGSLRLSCAASGITFRRHDMGWFRQAPGKEREFVAAIR WSSSSTVYADSVKGRFTISADNSKNTAYLQMNSLKPEDTAVYYCAADRGVY GGRWYRTSQYTWGQGTLVTVSS |
| 4-121 | 1313 | EVQLVESGGGLVQPGGSLRLSCAASGTAASFNPMGWFRQAPGKEREFVAAIT SGGSTNYADSVKGRFTISADNSKNTAYLQMNSLKPEDTAVYYCAAIAYEEGV YRWDWGQGTLVTVSS |
| 4-122 | 1314 | EVQLVESGGGLVQPGGSLRLSCAASGNINIINYMGWFRQAPGKEREGVAAIH WNGDSTAYADSVKGRFTISADNSKNTAYLQMNSLKPEDTAVYYCASGPPYS NYFAYWGQGTLVTVSS |
| 4-123 | 1315 | EVQLVESGGGLVQPGGSLRLSCAASGFTFDDYAMGWFRQAPGKERESVAAIS GSGGSTAYADSVKGRFTISADNSKNTAYLQMNSLKPEDTAVYYCAKIMGSGR PYFDHWGQGTLVTVSS |
| 4-124 | 1316 | EVQLVESGGGLVQPGGSLRLSCAASGNIFTRNVMGWFRQAPGKEREFVAAIT SSGSTNYADSVKGRFTISADNSKNTAYLQMNSLKPEDTAVYYCARPSSDLQG GVDYWGQGTLVTVSS |
| 4-125 | 1317 | EVQLVESGGGLVQPGGSLRLSCAASGRTFSSIAMGWFRQAPGKEREFVASIN WGGGNTIYADSVKGRFTISADNSKNTAYLQMNSLKPEDTAVYYCAAKGIWD YLGRRDFGDWGQGTLVTVSS |
| 4-126 | 1318 | EVQLVESGGGLVQPGGSLRLSCAASGIPSTLRAMGWFRQAPGKEREFVAAVS SLGPFTRYADSVKGRFTISADNSKNTAYLQMNSLKPEDTAVYYCAAKPGWV ARDPSEYNWGQGTLVTVSS |
| 4-127 | 1319 | EVQLVESGGGLVQPGGSLRLSCAASGFTLDDSAMGWFRQAPGKEREWVAAI TNGGSTYYADSVKGRFTISADNSKNTAYLQMNSLKPEDTAVYYCARFARGSP YFDFWGQGTLVTVSS |
| 4-128 | 1320 | EVQLVESGGGLVQPGGSLRLSCAASGSISSFNAMGWFRQAPGKERESVAAID WDGSTAYADSVKGRFTISADNSKNTAYLQMNSLKPEDTAVYYCARGGGYYG SGSFEYWGQGTLVTVSS |
| 4-129 | 1321 | EVQLVESGGGLVQPGGSLRLSCAASGNIFSDNIIGWFRQAPGKEREMVAYYTS GGSIDYADSVKGRFTISADNSKNTAYLQMNSLKPEDTAVYYCARGTAVGRPP PGGMDVWGQGTLVTVSS |
| 4-130 | 1322 | EVQLVESGGGLVQPGGSLRLSCAASGSISSIGAMGWFRQAPGKEREGVAAISS SGSSTVYADSVKGRFTISADNSKNTAYLQMNSLKPEDTAVYYCARVPPGQAY FDSWGQGTLVTVSS |
| 4-131 | 1323 | EVQLVESGGGLVQPGGSLRLSCAASGFTFDDYGMGWFRQAPGKERELVATIT WSGDSTYYADSVKGRFTISADNSKNTAYLQMNSLKPEDTAVYYCAKGGSWY YDSSGYYGRWGQGTLVTVSS |
| 4-132 | 1324 | EVQLVESGGGLVQPGGSLRLSCAASGRTFSNYTMGWFRQAPGKEREWVSAIS WSTGSTYYADSVKGRFTISADNSKNTAYLQMNSLKPEDTAVYYCAADRYGP PWYDWGQGTLVTVSS |

TABLE 22-continued

ACE2 Variant Sequences Variable Heavy Chain

| Name | SEQ ID | Amino Acid Sequence |
|---|---|---|
| 4-133 | 1325 | EVQLVESGGGLVQPGGSLRLSCAASGSTNYMGWFRQAPGKEREGVAAISMS GDDTIYADSVKGRFTISADNSKNTAYLQMNSLKPEDTAVYYCARIGLRGRYF DLWGQGTLVTVSS |
| 4-134 | 1326 | EVQLVESGGGLVQPGGSLRLSCAASGGTFSSVGMGWFRQAPGKERELVAVIN WSGARTYYADSVKGRFTISADNSKNTAYLQMNSLKPEDTAVYYCAVPWMD YNRRDWGQGTLVTVSS |
| 4-135 | 1327 | EVQLVESGGGLVQPGGSLRLSCAASGRIFTNTAMGWFRQAPGKEREGVAAIN WSGGSTAYADSVKGRFTISADNSKNTAYLQMNSLKPEDTAVYYCARTSGSYS FDYWGQGTLVTVSS |
| 4-136 | 1328 | EVQLVESGGGLVQPGGSLRLSCAASGEEFSDHWMGWFRQAPGKEREFVGAIH WSGGRTYYADSVKGRFTISADNSKNTAYLQMNSLKPEDTAVYYCAADRRGL ASTRAADYDWGQGTLVTVSS |
| 4-137 | 1329 | EVQLVESGGGLVQPGGSLRLSCAASGRTFSSIAMGWFRQAPGKEREFVAAIN WSGARTAYADSVKGRFTISADNSKNTAYLQMNSLKPEDTAVYYCAAKGIWD YLGRRDFGDWGQGTLVTVSS |
| 4-138 | 1330 | EVQLVESGGGLVQPGGSLRLSCAASGSTSSLRTMGWFRQAPGKEREGVAAISS RDGSTIYADSVKGRFTISADNSKNTAYLQMNSLKPEDTAVYYCARDDSSPYF DYWGQGTLVTVSS |
| 4-139 | 1331 | EVQLVESGGGLVQPGGSLRLSCAASGGGTFGSYAMGWFRQAPGKEREFVAAI SIASGASGGTTNYADSVKGRFTISADNSKNTAYLQMNSLKPEDTAVYYCATT MNPNPRWGQGTLVTVSS |
| 4-140 | 1332 | EVQLVESGGGLVQPGGSLRLSCAASGRTFSNAAMGWFRQAPGKEREFVARIT WNGGSTFYADSVKGRFTISADNSKNTAYLQMNSLKPEDTAVYYCATTENPNP RWGQGTLVTVSS |
| 4-141 | 1333 | EVQLVESGGGLVQPGGSLRLSCAASGIILSDNAMGWFRQAPGKEREFVAAIS WLGESTYYADSVKGRFTISADNSKNTAYLQMNSLKPEDTAVYYCAADRRGL ASTRAADYDWGQGTLVTVSS |
| 4-142 | 1334 | EVQLVESGGGLVQPGGSLRLSCAASGRTFGDYIMGWFRQAPGKERESVAAIN WNGGYTAYADSVKGRFTISADNSKNTAYLQMNSLKPEDTAVYYCATTSPNT GWHYYRWGQGTLVTVSS |
| 4-143 | 1335 | EVQLVESGGGLVQPGGSLRLSCAASGFNFNWYPMGWFRQAPGKERESVAAIS WTGVSTYTAYADSVKGRFTISADNSKNTAYLQMNSLKPEDTAVYYCARWGP GPAGGSPGLVGFDYWGQGTLVTVSS |
| 4-144 | 1336 | EVQLVESGGGLVQPGGSLRLSCAASGSIRSVSVMGWFRQAPGKEREAVAAIS WSGVGTAYADSVKGRFTISADNSKNTAYLQMNSLKPEDTAVYYCAAYQRG WGDWGQGTLVTVSS |
| 4-145 | 1337 | EVQLVESGGGLVQPGGSLRLSCAASGMTFRLYAMGWFRQAPGKEREFVGAI NWLSESTYYADSVKGRFTISADNSKNTAYLQMNSLKPEDTAVYYCAAKPGW VARDPSEYNWGQGTLVTVSS |
| 4-146 | 1338 | EVQLVESGGGLVQPGGSLRLSCAASGRTFSDDAMGWFRQAPGKEREFVAAIN WSGGSTYYADSVKGRFTISADNSKNTAYLQMNSLKPEDTAVYYCATDPPLF WGQGTMVTVSS |
| 4-147 | 1339 | EVQLVESGGGLVQPGGSLRLSCAASGGTFSVYAMGWFRQAPGKEREGVAAIS MSGDDAAYADSVKGRFTISADNSKNTAYLQMNSLKPEDTAVYYCAKISKDD GGKPRGAFFDSWGQGTLVTVSS |
| 4-148 | 1340 | EVQLVESGGGLVQPGGSLRLSCAASGFALGYYAMGWFRQAPGKERESVAAIS SRDGSTAYADSVKGRFTISADNSKNTAYLQMNSLKPEDTAVYYCARLATGPQ AYFHHWGQGTLVTVSS |
| 4-149 | 1341 | EVQLVESGGGLVQPGGSLRLSCAASGFNLDDYAMGWFRQAPGKERESVAAIS WDGGATAYADSVKGRFTISADNSKNTAYLQMNSLKPEDTAVYYCARVGRGT TAFDSWGQGTLVTVSS |
| 4-150 | 1342 | EVQLVESGGGLVQPGGSLRLSCAASGNTFSGGFMGWFRQAPGKEREFVASIR SGARTYYADSVKGRFTISADNSKNTAYLQMNSLKPEDTAVYYCAQRVRGFFG PLRTTPSWYEWGQGTLVTVSS |

TABLE 22-continued

ACE2 Variant Sequences Variable Heavy Chain

| Name | SEQ ID | Amino Acid Sequence |
|---|---|---|
| 4-151 | 1343 | EVQLVESGGGLVQPGGSLRLSCAASGSIRSINIMGWFRQAPGKEREAVAAISW SGGSTVYADSVKGRFTISADNSKNTAYLQMNSLKPEDTAVYYCASLLAGDRY FDYWGQGTLVTVSS |

TABLE 23

SARS-CoV-2 S1 Variable Heavy Chain C

TABLE 23-continued

SARS-CoV-2 S1 Variable Heavy Chain CDRs

| Name | SEQ ID NO | CDRH1 | SEQ ID NO | CDRH2 | SEQ ID NO | CDRH3 |
|---|---|---|---|---|---|---|
| 5-25 | 1368 | NTFSINVMG | 1548 | AAIHWSGDSTLYA | 1728 | CAAFDGYSGNHW |
| 5-26 | 1369 | RTISSYIMG | 1549 | ARIYTGGDTIYA | 1729 | CAARTSYNGRYDYIDDYSW |
| 5-27 | 1370 | RANSINWMG | 1550 | ATITPGGNTNYA | 1730 | CAAAAGSTWYGTLYEYDW |
| 5-28 | 1371 | GTFSVFAMG | 1551 | AEITAGGSTYYA | 1731 | CAVDGPFGW |
| 5-29 | 1372 | FTFDDYPMG | 1552 | ASVLRGGYTWYA | 1732 | CAKDWATGLAW |
| 5-30 | 1373 | FALGYYAMG | 1553 | AGIRWTDAYTEYA | 1733 | CAADVSPSYGSRWYW |
| 5-31 | 1374 | RTLDIHVMG | 1554 | AVINWTGESTLYA | 1734 | CAAFDGYTGNYW |
| 5-32 | 1375 | FTPDNYAMG | 1555 | AALGWSGVTTYHYYA | 1735 | CASDESDAANW |
| 5-33 | 1376 | FTFDDYAMG | 1556 | ATIMWSGNTTYYA | 1736 | CATNDDDV |
| 5-34 | 1377 | RTFSRYIMG | 1557 | AAISWSGGDNTYYA | 1737 | CAAYRIVVGGTSPGDWRW |
| 5-35 | 1378 | PTFSIYAMG | 1558 | AGISWNGGSTNYA | 1738 | CALRRRFGGQEW |
| 5-36 | 1379 | RTFSLNAMG | 1559 | AAISCGGGSTYA | 1739 | CAADNDMGYCSW |
| 5-37 | 1380 | STFSINAMG | 1560 | GGISRSGATTNYA | 1740 | CAADGVPEYSDYASGPVW |
| 5-38 | 1381 | RTFSMHAMG | 1561 | ASISSQGRTNYA | 1741 | CAAEVRNGSDYLPIDW |
| 5-39 | 1382 | VTLDLYAMG | 1562 | AGIRWTDAYTEYA | 1742 | CAVDIDYRDW |
| 5-40 | 1383 | LPFTINVMG | 1563 | AAIHWSGLTTFYA | 1743 | CAELDGYFFAHW |
| 5-41 | 1384 | RAFSNYAMG | 1564 | AWINNRGTTDYADSGSTYYA | 1744 | CASTDDYGVDW |
| 5-42 | 1385 | FTPDDYAMG | 1565 | ASIGYSGRSNSYNYYA | 1745 | CAIAHGSSTYNW |
| 5-43 | 1386 | FTLNYYGMG | 1566 | AAITSGGAPHYA | 1746 | CASAYDRGIGYDW |
| 5-44 | 1387 | LPFSTKSMG | 1567 | AAIHWSGLTSYA | 1747 | CAADRAADFFAQRDEYDW |
| 5-45 | 1388 | RTFSINAMG | 1568 | AAISWSGESTQYA | 1748 | CAAFDGGSGTQW |
| 5-46 | 1389 | EEFSDHWMG | 1569 | AAIHWSGDSTHRNYA | 1749 | CATVGITLNW |
| 5-47 | 1390 | FTFGSYDMG | 1570 | TAINWSGARTAYA | 1750 | CAARSVYSYEYNW |
| 5-48 | 1391 | LPLDLYAMG | 1571 | AGIRWSDAYTEYA | 1751 | CALDIDYRHW |
| 5-49 | 1392 | RTSTVNGMG | 1572 | ASISQSGAATAYA | 1752 | CAADRTYSYSSTGYYW |
| 5-50 | 1393 | FSLDYYGMG | 1573 | AAITSGGTPHYA | 1753 | CASAYNPGIGYDW |
| 5-51 | 1394 | RPNSINWMG | 1574 | ATITPGGNTNYA | 1754 | CAAAAGTTWYGTLYEYDW |
| 5-52 | 1395 | EKFSDHWMG | 1575 | ATITFSGARTAYA | 1755 | CAALIKPSSTDRIFEEW |

TABLE 23-continued

SARS-CoV-2 S1 Variable Heavy Chain CDRs

| Name | SEQ ID NO | CDRH1 | SEQ ID NO | CDRH2 | SEQ ID NO | CDRH3 |
|---|---|---|---|---|---|---|
| 5-53 | 1396 | LTVVPYAMG | 1576 | AAIRRSAVTNYA | 1756 | CAARRWGYHYW |
| 5-54 | 1397 | TTFNFNVMG | 1577 | AVISWTGESTLYA | 1757 | CAAFDGYTGRDW |
| 5-55 | 1398 | IDVNRNAMG | 1578 | AAITWSGGWRYYA | 1758 | CATTFGDAGIPDQYDFGW |
| 5-56 | 1399 | RTFSSNMG | 1579 | ARIFGGDRTLYA | 1759 | CADINGDW |
| 5-57 | 1400 | GTFSMGWIR | 1580 | GCIGWITYYA | 1760 | CAPFGW |
| 5-58 | 1401 | CTLDYYAMG | 1581 | AGIRWTDAYTEYA | 1761 | CAADVSPSYGGRWYW |
| 5-59 | 1402 | LTFSLYRMC | 1582 | SCISNIDGSTYYA | 1762 | CAADLLGDSDYEPSSGFGW |
| 5-60 | 1403 | RSFSSHRMG | 1583 | AAIMWSGSHRNYA | 1763 | CAAIAYEEGVYRWDW |
| 5-61 | 1404 | RIIVPNTMG | 1584 | TGISPSAFTEYA | 1764 | CAAHGWGCHW |
| 5-62 | 1405 | SIFIISMG | 1585 | TGINWSGGSTTYA | 1765 | CAASAIGSALRRFEYDW |
| 5-63 | 1406 | FSLDYYDMG | 1586 | AALGWSGGSTDYA | 1766 | CAAGNGGRYGIVERW |
| 5-64 | 1407 | TSISNRVMG | 1587 | ARIYTGGDTLYA | 1767 | CAARKIYRSLSYYGDYDW |
| 5-65 | 1408 | NIDRLYAMG | 1588 | AAIDSDGSTDYA | 1768 | CAALIDYGLGFPIEW |
| 5-66 | 1409 | NTFTINVMG | 1589 | AAINWNGGTTLYA | 1769 | CAAFDGYSGIDW |
| 5-67 | 1410 | FNVNDYAMG | 1590 | AGITSSVGVTNYA | 1770 | CAADIFFVNW |
| 5-68 | 1411 | FTFDHYTMG | 1591 | AAISGSENVTSYA | 1771 | CAAEPYIPVRTMRHMTFLTW |
| 6-1 | 1412 | RTFGNYNMG | 1592 | ATINSLGGTSYA | 1772 | CARVDYYMDVW |
| 6-2 | 1413 | FTMSSSWMG | 1593 | TVISGVGTSYA | 1773 | CARGPDSSGYGFDYW |
| 6-3 | 1414 | FTFSPSWMG | 1594 | ATINEYGGRNYA | 1774 | CARVDRDFDYW |
| 6-4 | 1415 | FTRDYYTMG | 1595 | AAISRSGSLTSYA | 1775 | CANLAYYDSSGYYDYW |
| 6-5 | 1416 | RTFTMG | 1596 | ASTNSAGSTNYA | 1776 | CTTVDQYFDYW |
| 6-6 | 1417 | TTLDYYAMG | 1597 | AAISWGGSTAYA | 1777 | CARED YYDSSGYSW |
| 6-7 | 1418 | FTFSSYWMG | 1598 | ATINWSGVTAYA | 1778 | CARADDYFDYW |
| 6-8 | 1419 | FTLSGIWMG | 1599 | AIITTGGRTTYA | 1779 | CAGYSTFGSSSAYYYYSMDVG |
| 6-9 | 1420 | FTFDYYAMG | 1600 | SAIDSEGRTSYA | 1780 | CARWGPFDIW |
| 6-10 | 1421 | SIASIHAMG | 1601 | AAISRSGGFGSYA | 1781 | CARDDKYYDSSGYPAYFQHW |
| 6-11 | 1422 | LAFNAYAMG | 1602 | ATIGWSGANTYYA | 1782 | CASDPPGW |
| 6-12 | 1423 | STYTTYSMG | 1603 | AAISGSENVTSYA | 1783 | CARVDDYMDVW |
| 6-13 | 1424 | LTFNDYAMG | 1604 | AHIPRSTYSPYYA | 1784 | CAFLVGPQGVDHGAFDVW |

TABLE 23-continued

SARS-CoV-2 S1 Variable Heavy Chain CDRs

| Name | SEQ ID NO | CDRH1 | SEQ ID NO | CDRH2 | SEQ ID NO | CDRH3 |
|---|---|---|---|---|---|---|
| 6-14 | 1425 | ITFRFKAMG | 1605 | AAVSWDGRNTYYA | 1785 | CASDYYYMDVW |
| 6-15 | 1426 | STVLINAMG | 1606 | AAVRWSDDYTYYA | 1786 | CAKEGRAGSLDYW |
| 6-16 | 1427 | FTFDDAAMG | 1607 | AHISWSGGSTYYA | 1787 | CATFGATVTATNDAFDIW |
| 6-17 | 1428 | NTGSTGYMG | 1608 | AGVINDGSTVYA | 1788 | CARLATSHQDGTGYLFDYW |
| 6-18 | 1429 | LTFRNYAMG | 1609 | AGMMWSGGTTTYA | 1789 | CAREGYYYDSSGYLNYFDYW |
| 6-19 | 1430 | SILSIAVMG | 1610 | AAISPSAVTTYYA | 1790 | CAIGYYDSSGYFDYW |
| 6-20 | 1431 | STLPYHAMG | 1611 | AAITWNGASTSYA | 1791 | CARDRYYDTSASYFESETW |
| 6-21 | 1432 | TLFKINAMG | 1612 | AAITSSGSNIDYTYYA | 1792 | CARSNTGWYSFDYW |
| 6-22 | 1433 | RTFSEVVMG | 1613 | ATIHSSGSTSYA | 1793 | CVRVTSDYSMDSW |
| 6-23 | 1434 | SIFSMNTMG | 1614 | ALINRSGGGINYA | 1794 | CVRLSSGYYDFDYW |
| 6-24 | 1435 | FTLDYYAMG | 1615 | AAINWSGDNTHYA | 1795 | CARAPFYCTTTKCQDNYYMDVW |
| 6-25 | 1436 | ltfgtytmg | 1616 | AAISRFGSTYYA | 1796 | CARGGDYDFWSVDYMDVW |
| 6-26 | 1437 | DTFSTSWMG | 1617 | ATINTGGGTNYA | 1797 | CARVTTSFDYW |
| 6-27 | 1438 | ITFRFKAMG | 1618 | ASISRSGTTYYA | 1798 | CATDYSAFDMW |
| 6-28 | 1439 | DTYGSYWMG | 1619 | ATITSDDRTNYA | 1799 | CARVTSSLSGMDVW |
| 6-29 | 1440 | YTLKNYYAMG | 1620 | AAIIWTGESTLDA | 1800 | CAREGYYDSSGYYW |
| 6-30 | 1441 | FAFGDSWMG | 1621 | ATINWSGVTAYA | 1801 | CARADGYFDYW |
| 6-31 | 1442 | DTFSANRMG | 1622 | ASITWSSANTYYA | 1802 | CATFNWNDEGFDFW |
| 6-32 | 1443 | FTLDYYDMG | 1623 | ALISWSGGSTYYA | 1803 | CATDFYGWGTRERDAFDIW |
| 6-33 | 1444 | TFQRINHMG | 1624 | ATINTGGQPNYA | 1804 | CASLIAAQDYYFDYW |
| 6-34 | 1445 | SAFRSNAMG | 1625 | AHISWSSKSTYYA | 1805 | CATYCSSTSCFDYW |
| 6-35 | 1446 | FTLAYYAMG | 1626 | AAISMSGDDTIYA | 1806 | C ARELGYSSTVWPW |
| 6-36 | 1447 | FDFSVSWMG | 1627 | TAITWSGDSTNYA | 1807 | CASLLHTGPSGGNYFDYW |
| 6-37 | 1448 | HTFSTSWMG | 1628 | ATINSLGGTNYA | 1808 | CARVSSGDYGMDVW |
| 6-38 | 1449 | NTFSGGFMG | 1629 | AVISSLSSKSYA | 1809 | CAKVDSGYDYW |
| 6-39 | 1450 | FTFSPSWMG | 1630 | AAISWSGGSTAYA | 1810 | CHGLGEGDPYGDYEGYFDLW |
| 6-40 | 1451 | FTFSDYWMG | 1631 | ARVWWNGGSAYYA | 1811 | CAREVLRQQVVLDYW |
| 6-41 | 1452 | FTFSTSWMG | 1632 | ASINEYGGRNYA | 1812 | CAGLHYYYDSSGYNPTEYYGMDVW |

TABLE 23-continued

SARS-CoV-2 S1 Variable Heavy Chain CDRs

| Name | SEQ ID NO | CDRH1 | SEQ ID NO | CDRH2 | SEQ ID NO | CDRH3 |
|---|---|---|---|---|---|---|
| 6-42 | 1453 | DTYGSYWMG | 1633 | AVITSGGSTNYA | 1813 | CTHVQNSYYYAMDVW |
| 6-43 | 1454 | RTFSSYAMMG | 1634 | ASVNWDASQINYA | 1814 | CTTLGAVYFDSSGYHDYFDYW |
| 6-44 | 1455 | GTFGVYHMG | 1635 | GRITWTDGSTYYA | 1815 | CFGLLEVYDMTFDYW |
| 6-45 | 1456 | NMFSINAMG | 1636 | TLISWSSGRTSYA | 1816 | CASLGYCSGGSCFDYW |
| 6-46 | 1457 | LTFSAMG | 1637 | ALIRRDGSTIYA | 1817 | CAALGILFGYDAFDIW |
| 6-47 | 1458 | RTFSMHAMG | 1638 | ASITYGGNINYA | 1818 | CAKEGYYDSTGYRTYFQQW |
| 6-48 | 1459 | FTVSNYAMG | 1639 | ASVNWSGGTTSYA | 1819 | CATTGTVTLGYW |
| 6-49 | 1460 | STVLINAMG | 1640 | AAISWSPGRTDYA | 1820 | CARDCSGGSCYSGDYW |
| 6-50 | 1461 | FSFDRWAMG | 1641 | ASLATGGNTNYA | 1821 | CARVTNYDAFDIW |
| 6-51 | 1462 | YTYSSYVMG | 1642 | AAISRFGSTYYA | 1822 | CARDSGEHFWDSGYIDHW |
| 6-52 | 1463 | DTYGSYWMG | 1643 | AAITSGGSTVYA | 1823 | CARVDSRFDYW |
| 6-53 | 1464 | ISINTNVMG | 1644 | AAISTGGSVTIYA | 1824 | CARVDDFGYFDLW |
| 6-54 | 1465 | FEFENHWMG | 1645 | AHITAGGLSNYA | 1825 | CGRHWGIYDSSGFSSFDYW |
| 6-55 | 1466 | FTMSSSWMG | 1646 | ARITSGGSTGYA | 1826 | CASVDGYFDYW |
| 6-56 | 1467 | NIFRSNMG | 1647 | AGITWNGDTTYYA | 1827 | CARALGVTYQFDYW |
| 6-57 | 1468 | LTFDDHSMG | 1648 | AAVPLSGNTYYA | 1828 | CASFSGGPADFDYW |
| 6-58 | 1469 | RAVSTYAMG | 1649 | AAISGSENVTSYA | 1829 | CLSVTGDTEDYGVFDTW |
| 6-59 | 1470 | ISGSVFSRTPMG | 1650 | SSIYSDGSNTYYA | 1830 | CAHWSWELGDWFDPW |
| 6-60 | 1471 | DTYGSYWMG | 1651 | ATISQSGAATAYA | 1831 | CAGLLRYSGTYYDAFDVW |
| 6-61 | 1472 | DTYGSYWMG | 1652 | AAINWSGGSTNYA | 1832 | CAGLGWNYMDYW |
| 6-62 | 1473 | STFSGNWMG | 1653 | AVISWTGGSTYYA | 1833 | CATHNSLSGFDYW |
| 6-63 | 1474 | QTFNMG | 1654 | AAIGSGGSTSYA | 1834 | CWRLGNDYFDYW |
| 6-64 | 1475 | IPSIHAMG | 1655 | AAINWSHGVTYYA | 1835 | CGGGYGYHFDYW |
| 6-65 | 1476 | LPFSTLHMG | 1656 | ASLSIFGATGYA | 1836 | CWMYYYDSSGYYGNYYYGMDVW |
| 6-66 | 1477 | LTFSLFAMG | 1657 | AAISSGGSTDYA | 1837 | CARGNTKYYYDSSGYSSAFDYW |
| 6-67 | 1478 | SFSNYAMG | 1658 | AAISSSGALTSYA | 1838 | CWIVGPGPLDGMDVW |
| 6-68 | 1479 | FTLSDRAMG | 1659 | AHITAGGLSNYA | 1839 | CVHLASQTGAGYFDLW |

TABLE 23-continued

SARS-CoV-2 S1 Variable Heavy Chain CDRs

| Name | SEQ ID NO | CDRH1 | SEQ ID NO | CDRH2 | SEQ ID NO | CDRH3 |
|---|---|---|---|---|---|---|
| 6-69 | 1480 | GTFSSVGMG | 1660 | AGISRSGGTYYA | 1840 | CARYDFWSGYPYW |
| 6-70 | 1481 | FNLDDYADMG | 1661 | AAIGWGGGSTRYA | 1841 | CAREILWFGEFGEPNVW |
| 6-71 | 1482 | ITFSNDAMG | 1662 | AIITSSDTNDTTNYA | 1842 | CARLHYYDSSGYFDYW |
| 6-72 | 1483 | STLSINAMG | 1663 | AAIDWSGGSTAYA | 1843 | CARDSSATRTGPDYW |
| 6-73 | 1484 | HTFSGYAMG | 1664 | AVITREGSTYYA | 1844 | CARLGGEGFDYW |
| 6-74 | 1485 | FAFGDSWMG | 1665 | AAITSGGSTDYA | 1845 | CARGLLWFGELFGYW |
| 6-75 | 1486 | GTFSTYWMG | 1666 | AAISRSGGNTYYA | 1846 | CVRHSGTDGDSSFDYW |
| 6-76 | 1487 | LAFDFDGMG | 1667 | AAINSGGSTYYA | 1847 | CARFFRAHDYW |
| 6-77 | 1488 | FTFDRSWMG | 1668 | AAVTEGGTTSYA | 1848 | CARADYDFDYW |
| 6-78 | 1489 | RTYDAMG | 1669 | ASVTSGGYTHYA | 1849 | CAKFGRKIVGATELDYW |
| 6-79 | 1490 | SISSIDYMG | 1670 | SWISSSDGSTYYA | 1850 | CARSPSFSQIYYYYYMDVW |
| 6-80 | 1491 | GTFSFYNMG | 1671 | AFISGNGGTSYA | 1851 | CAVVAMRMVTTEGPDVLDVW |
| 6-81 | 1492 | FIGNYHAMG | 1672 | AAVTWSGGTTNYA | 1852 | CAREGYYYDSSGYPYYFDYW |
| 6-82 | 1493 | SSLDAYGMG | 1673 | AAISWGGGSIYYA | 1853 | CARLSQGMVALDYW |
| 6-83 | 1494 | SIASIHAMG | 1674 | AAITWSGAITSYA | 1854 | CAKDGGYGELHYGMEVW |
| 6-84 | 1495 | FTPDDYAMG | 1675 | AAINSGGSYTYYA | 1855 | CARDRGPW |
| 6-85 | 1496 | GTFSVFAMG | 1676 | SAINWSGGSLLYA | 1856 | CALFGDFDYW |
| 6-86 | 1497 | PISGINRMG | 1677 | AVITSNGRPSYA | 1857 | CVRLSSGYFDFDYW |
| 6-87 | 1498 | TSIMVGAMG | 1678 | AIIRGDGRTSYA | 1858 | CARFAGWDAFDIW |
| 6-88 | 1499 | RTFSTHWMG | 1679 | AVINWSGGSIYYA | 1859 | CARLSSDGYNYFDFW |
| 6-89 | 1500 | TIFASAMG | 1680 | AVVNWNGSSTVYA | 1860 | CTTVDQYFNYW |
| 6-90 | 1501 | FPFSIWPMG | 1681 | AAVRWSSTYYA | 1861 | CATGECDGGSCSLAYW |
| 6-91 | 1502 | RTFGNYAMG | 1682 | ASISSSGVSKHYA | 1862 | CVRFGSSWARDLDQW |
| 6-92 | 1503 | FLFDSYASMG | 1683 | ATIWRRGNTYYANYA | 1863 | CTETGTAAW |
| 6-93 | 1504 | LPFSTKSMG | 1684 | AAISMSGLTSYA | 1864 | CLKVLGGDYEADNWFDYW |
| 6-94 | 1505 | NIFRIETMG | 1685 | AGIIRSGGETLYA | 1865 | CARSLYYDRSGSYYFDYW |
| 6-95 | 1506 | IPSSIRAMG | 1686 | AVIRWTGGSTYYA | 1866 | CARDIGYYDSSGYYNDGGFDYW |
| 6-96 | 1507 | FTLSGNWMG | 1687 | AIITSGGRTNYA | 1867 | CAGHATFGGSSSSYYYGMDVW |
| 6-97 | 1508 | FTFSSLAMG | 1688 | AAITWSGDITNYA | 1868 | CLRLSSSGFDHW |

TABLE 23-continued

| SARS-CoV-2 S1 Variable Heavy Chain CDRs | | | | | | |
|---|---|---|---|---|---|---|
| Name | SEQ ID NO | CDRH1 | SEQ ID NO | CDRH2 | SEQ ID NO | CDRH3 |
| 6-98 | 1509 | TFGHYAMG | 1689 | AAINWSSRSTVYA | 1869 | CAKSDGLMGELRSASAFDIW |
| 6-99 | 1510 | IPFRSRTMG | 1690 | AGISRSGASTAYA | 1870 | CTHANDYGDYW |
| 6-100 | 1511 | GTFSTSWMG | 1691 | AHITAGGLSNYA | 1871 | CARLLVREDWYFDLW |
| 6-101 | 1512 | GTFSLFAMG | 1692 | AAISWTGDSTYYKYYA | 1872 | CAYNNSSGEYW |
| 6-102 | 1513 | SSFSAYAMG | 1693 | SAIDSEGTTTYA | 1873 | CAGDYNFWSGFDHW |
| 6-103 | 1514 | RTSSPIAMG | 1694 | AVRWSDDYTYYA | 1874 | CAKKLGGYYAFDIW |
| 6-104 | 1515 | LTFNQYTMG | 1695 | ASITDGGSTYYA | 1875 | CARDSRYMDVW |
| 6-105 | 1516 | PTFSSMG | 1696 | AAISWDGGATAYA | 1876 | CAIEIVVGGIYW |
| 6-106 | 1517 | IPSTLRAMG | 1697 | AATSWSGGSKYYA | 1877 | CATDLYYMDVW |
| 6-107 | 1518 | GVGFSVTNMG | 1698 | AVISSSSSTNYA | 1878 | CTTFNWNDEGFDYW |
| 6-108 | 1519 | GTFGSYGMG | 1699 | AAIRWSGGITYYA | 1879 | CARERYWNPLPYYYYGMDVW |
| 6-109 | 1520 | GTFSTYAMG | 1700 | ASIDWSGLTSYA | 1880 | CARGPFYMYCSGTKCYSTNWFDPW |
| 6-110 | 1521 | PIYAVNRMG | 1701 | AGIWRSGGHRDYA | 1881 | CARGEIDILTGYWYDYW |
| 6-111 | 1522 | FTFSNYWMG | 1702 | GGISRSGVSTSYA | 1882 | CTTLLYYYDSSGYSFDAFDIW |
| 6-112 | 1523 | GTFSAYHMG | 1703 | TIIDNGGPTSYA | 1883 | CTALLYYFDNSGYNFDPFDIW |

TABLE 24

| SARS-CoV-2 S1 Variant Variably Heavy Chain | | |
|---|---|---|
| Name | SEQ ID NO | Amino Acid Sequence |
| 5-1 | 1884 | EVQLVESGGGLVQPGGSLRLSCAASGGTFSSIGMGWFRQAPGKEREFVAAISWDGGATAYADSVKGRFTISADNSKNTAYLQMNSLKPEDTAVYYCAKEDVGKPFDWGQGTLVTVSS |
| 5-2 | 1885 | EVQLVESGGGLVQPGGSLRLSCAASGLRFDDYAMGWFRQAPGKERELVAIKFSGGTTDYADSVKGRFTISADNSKNTAYLQMNSLKPEDTAVYYCASWDGLIGLDAYEYDWGQGTLVTVSS |
| 5-3 | 1886 | EVQLVESGGGLVQPGGSLRLSCAASGSIFSIDVMGWFRQAPGKEREFVAGISWSGDSTLYADSVKGRFTISADNSKNTAYLQMNSLKPEDTAVYYCAAFDGYTGSDWGQGTLVTVSS |
| 5-4 | 1887 | EVQLVESGGGLVQPGGSLRLSCAASGFTLADYAMGWFRQAPGKEREFVAVITCSGGSTDYADSVKGRFTISADNSKNTAYLQMNSLKPEDTAVYYCAADDCYIGCGWGQGTLVTVSS |
| 5-5 | 1888 | EVQLVESGGGLVQPGGSLRLSCAASGRTFSSIAMGWFRQAPGKERELVAEITEGGISPSGDNIYYADSVKGRFTISADNSKNTAYLQMNSLKPEDTAVYYCAAELHSSDYTSPGAESDYGWGQGTLVTVSS |
| 5-6 | 1889 | EVQLVESGGGLVQPGGSLRLSCAASGPTFSSYAMMGWFRQAPGKEREWVAAINNFGTTKYADSVKGRFTISADNSKNTAYLQMNSLKPEDTAVYYCAASASDYGLGLELFHDEYNWGQGTLVTVSS |

TABLE 24-continued

SARS-CoV-2 S1 Variant Variably Heavy Chain

| Name | SEQ ID NO | Amino Acid Sequence |
|---|---|---|
| 5-7 | 1890 | EVQLVESGGGLVQPGGSLRLSCAASGSTGYMGWFRQAPGKEREFVAAIH SGGSTNYADSVKGRFTISADNSKNTAYLQMNSLKPEDTAVYYCATVATA LIWGQGTLVTVSS |
| 5-8 | 1891 | EVQLVESGGGLVQPGGSLRLSCAASGRPFSEYTMGWFRQAPGKEREFVSS IHWGGRGTNYADSVKGRFTISADNSKNTAYLQMNSLKPEDTAVYYCAAE LHSSDYTSPGAYAWGQGTLVTVSS |
| 5-9 | 1892 | EVQLVESGGGLVQPGGSLRLSCAASGLTLSTYGMGWFRQAPGKEREFVA HIPRSTYSPYYADSVKGRFTISADNSKNTAYLQMNSLKPEDTAVYYCAAI GDGAVWGQGTLVTVSS |
| 5-10 | 1893 | EVQLVESGGGLVQPGGSLRLSCAASGFTFNNHNMGWFRQAPGKEREFVA AISSYSHTAYADSVKGRFTISADNSKNTAYLQMNSLKPEDTAVYYCALQP FGASNYRWGQGTLVTVSS |
| 5-11 | 1894 | EVQLVESGGGLVQPGGSLRLSCAASGGIYRVMGWFRQAPGKERELVASIS SGGGINYADSVKGRFTISADNSKNTAYLQMNSLKPEDTAVYYCAAESWG RQWGQGTLVTVSS |
| 5-12 | 1895 | EVQLVESGGGLVQPGGSLRLSCAASGYTDSNLWMGWFRQAPGKEREFVA INRSTGSTSYADSVKGRFTISADNSKNTAYLQMNSLKPEDTAVYYCATSG SGSPNWGQGTLVTVSS |
| 5-13 | 1896 | EVQLVESGGGLVQPGGSLRLSCAASGFTFDYYTMGWFRQAPGKEREFVA AIRSSGGLFYADSVKGRFTISADNSKNTAYLQMNSLKPEDTAVYYCAAYL DGYSGSWGQGTLVTVSS |
| 5-14 | 1897 | EVQLVESGGGLVQPGGSLRLSCAASGGIFSINVMGWFRQAPGKEREWVSA IRWNGGNTAYADSVKGRFTITADNSKNTAYLQMNSLKPEDTAVYYCAGF DGYTGSDWGQGTLVTVSS |
| 5-15 | 1898 | EVQLVESGGGLVQPGGSLRLSCAASGFTFDGAAMGWFRQAPGKEREFVA TIRWTNSTDYADSVKGRFTISADNSKNTAYLQMNSLKPEDTAVYYCARG RYGIVERWGQGTLVTVSS |
| 5-16 | 1899 | EVQLVESGGGLVQPGGSLRLSCAASGRTHSIYPMGWFRQAPGKERELVAA IHSGGATVYADSVKGRFTISADNSKNTAYLQMNSLKPEDTAVYYCAARR WIPPGPIWGQGTLVTVSS |
| 5-17 | 1900 | EVQLVESGGGLVQPGGSLRLSCAASGPTFSIYAMGWFRQAPGKEREFVAG IRWSDVYTQYADSVKGRFTISADNSKNTAYLQMNSLKPEDTAVYYCALDI DYRDWGQGTLVTVSS |
| 5-18 | 1901 | EVQLVESGGGLVQPGGSLRLSCAASGLTFDDNIHVMGWFPQAPGKEREFV AAIHWSGGSTIYADSVKGRFTINADNSKNTAYLQMNSLKPEDTAVYYCA ADVYPQDYGLGYVEGKMYYGMDWGQGTLVTVSS |
| 5-19 | 1902 | EVQLVESGGGLVQPGGSLRLSCAASGLTLDYYAMGWFRQAPGKEREWV ASINWSGGSTYYADSVKGRFTISADNSKNTAYLQMNSLKPEDTAVYYCA AYGSGEFDWGQGTLVTVSS |
| 5-20 | 1903 | EVQLVESGGGLVQPGGSLRLSCAASGRTIVPYTMGWFRQAPGKERELVA AISPSAFTEYADSVKGRFTISADNSKNTAYLQMNSLKPEDTAVYYCAARR WGYDWGQGTLVTVSS |
| 5-21 | 1904 | EVQLVESGGGLVQPGGSLRLSCAASGGTFTTYHMGWFRQAPGKEREFVA HISTGGATNYADSVKGRFTISADNSKNTAYLQMNSLKPEDTAVYYCATFP AIVTDSDYDLGNDWGQGTLVTVSS |
| 5-22 | 1905 | EVQLVESGGGLVQPGGSLRLSCAASGFTFNVFAMGWFRQAPGKEREFVA AINWSDSRTDYADSVKGRFTISADNSKNTAYLQMNSLKPEDTAVYYCAS GSDNRARELSRYEYVWGQGTLVTVSS |
| 5-23 | 1906 | EVQLVESGGGLVQPGGSLRLSCAASGSIFSIDVMGWFRQAPGKEREFVAAI SWSGESTLYADSVKGRFTISADNSKNTAYLQMNSLKPEDTAVYYCAAFD GYSGSDWGQGTLVTVSS |
| 5-24 | 1907 | EVQLVESGGGLVQPGGSLRLSCAASGFTFSSYSMGWFRQAPGKEREFVAA ISSYSHTAYADSVKGRFTIIADNSKNTAYLQMNSLKPEDTAVYYCALQPFG ASSYRWGQGTLVTVSS |

TABLE 24-continued

SARS-CoV-2 S1 Variant Variably Heavy Chain

| Name | SEQ ID NO | Amino Acid Sequence |
|---|---|---|
| 5-25 | 1908 | EVQLVESGGGLVQPGGSLRLSCAASGNTFSINVMGWFRQAPGKEREFVA AIHWSGDSTLYADSGKGRFTIIADNNKNTAYLQMISLKPEDTAVYYCAAF DGYSGNHWGQGTLVTVSS |
| 5-26 | 1909 | EVQLVESGGGLVQPGGSLRLSCAASGRTISSYIMGWFRQAPGKERELVARI YTGGDTIYADSVKGRFTISADNSKNTAYLQMNSLKPEDTAVYYCAARTSY NGRYDYIDDYSWGQGTLVTVSS |
| 5-27 | 1910 | EVQLVESGGGLVQPGGSLRLSCAASGRANSINWMGWFRQAPGKEREFVA TITPGGNTNYADSVKGRFTISADNSKNTAYLQMNSLKPEDTAVYYCAAAA GSTWYGTLYEYDWGQGTLVTVSS |
| 5-28 | 1911 | EVQLVESGGGLVQPGGSLRLSCAASGGTFSVFAMGWFRQVPGKERELVA EITAGGSTYYADSVKGRFTISADNSKNTAYLQMNSLKPEDTAVYYCAVDG PFGWGQGTLVTVSS |
| 5-29 | 1912 | EVQLVESGGGLVQPGGSLRLSCAASGFTFDDYPMGWFRQAPGKEREGVA SVLRGGYTWYADSVKGRFTISADNSKNTAYLQMNSLKPEDTAVYYCAKD WATGLAWGQGTLVTVSS |
| 5-30 | 1913 | EVQLVESGGGLVQPGGSLRLSCAASGFALGYYAMGWFRQAPGKEREFVA GIRWTDAYTEYADSVKGRFTISADNSKNTAYLQMNSLKPEDTAVYYCAA DVSPSYGSRWYWGQGTLVTVSS |
| 5-31 | 1914 | EVQLVESGGGLVQPGGSLRLSCAASGRTLDIHVMGWFRQAPGKEREFVA VINWTGESTLYADSVKGRFTISADNSKNTAYLQMNSLKPEDTAVYYCAAF DGYTGNYWGQGTLVTVSS |
| 5-32 | 1915 | EVQLVESGGGLVQPGGSLRLSCAASGFTPDNYAMGWFRQAPGKEREFVA ALGWSGVTTYHYYADSVKGRFTISADNSKNTAYLQMNSLKPEDTAVYYC ASDESDAANWGQGTLVTVSS |
| 5-33 | 1916 | EVQLVESGGGLVQPGGSLRLSCAASGFTFDDYAMGWFRQAPGKERELVA TIMWSGNTTYYADSVRRRFIIRDNNNKNTAHLQMNSLKPEDTAVYYCAT NDDDVWGQGTLVTVSS |
| 5-34 | 1917 | EVQLVESGGGLVQPGGSLRLSCAASGRTFSRYIMGWFRQAPGKEREFVAA ISWSGGDNTYYADSVKGRFTISADNSKNTAYLQMNSLKPEDTAVYYCAA YRIVVGGTSPGDWRWGQGTLVTVSS |
| 5-35 | 1918 | EVQLVESGGGLVQPGGSLRLSCAASGPTFSIYAMGWFRQAPGKERELVAG ISWNGGSTNYADSVKGRFTISADNSKNTAYLQMNSLKPEDTAVYYCALR RRFGGQEWGQGTLVTVSS |
| 5-36 | 1919 | EVQLVESGGGLVQPGGSLRLSCAASGRTFSLNAMGWFRQAPGKERELVA AISCGGGSTYADNGKGRFTIITDNSKNTAYLQMMNLKPEDTAAYYCAAD NDMGYCSWGQGTLVTVSS |
| 5-37 | 1920 | EVQLVESGGGLVQPGGSLRLSCAASGSTFSINAMGWFRQAPGKEREFVGG ISRSGATTNYADSVKGRFTISADNSKNTAYLQMNSLKPEDTAVYYCAADG VPEYSDYASGPVWGQGTLVTVSS |
| 5-38 | 1921 | EVQLVESGGGLVQPGGSLRLSCAASGRTFSMHAMGWFRQAPGKERELVA SISSQGRTNYADSVKGRFTISADNSKNTAYLQMNSLKPEDTAVYYCAAEV RNGSDYLPIDWGQGTLVTVSS |
| 5-39 | 1922 | EVQLVESGGGLVQPGGSLRLSCAASGVTLDLYAMGWFRQAPGKEREFVA GIRWTDAYTEYADSVKGRFTISADNSKNTAYLQMNSLKPEDTAVYYCAV DIDYRDWGQGTLVTVSS |
| 5-40 | 1923 | EVQLVESGGGLVQPGGSLRLSCAASGLPFTINVMGWFRQAPGKEREFVAA IHWSGLTTFYADSVKGLFTITEDNSKNTAHLMMNLLKPEDTAVYCCAELD GYFFAHWGQGTLVTVSS |
| 5-41 | 1924 | EVQLVESGGGLVQPGGSLRLSCAASGRAFSNYAMGWFRQAPGKEREFVA WINNRGTTDYADSGSTYYADSVKGRFTISADNSKNTAYLQMNSLKPEDT AVYYCASTDDYGVDWGQGTLVTVSS |
| 5-42 | 1925 | EVQLVESGGGLVQPGGSLRLSCAASGFTPDDYAMGWFRQAPGKEREFVA SIGYSGRSNSYNYYADSVKGRFTISADNSKNTAYLQMNSLKPEDTAVYYC AIAHGSSTYNWGQGTLVTVSS |

TABLE 24-continued

SARS-CoV-2 S1 Variant Variably Heavy Chain

| Name | SEQ ID NO | Amino Acid Sequence |
|---|---|---|
| 5-43 | 1926 | EVQLVESGGGLVQPGGSLRLSCAASGFTLNYYGMGWFPQAPGKEREFVA<br>AITSGGAPHYADSVKGRFTINADNSKNTAYLQMNSLKPEDTAVYYCASA<br>YDRGIGYDWGQGTLVTVSS |
| 5-44 | 1927 | EVQLVESGGGLVQPGGSLRLSCAASGLPFSTKSMGWFRQAPGKEREFVAA<br>IHWSGLTSYADSVKGRFTISADNSKNTAYLQMNSLKPEDTAVYYCAADR<br>AADFFAQRDEYDWGQGTLVTVSS |
| 5-45 | 1928 | EVQLVESGGGLVQPGGSLRLSCAASGRTFSINAMGWFPQAPGKERELVAA<br>ISWSGESTQYADSVKGRFTISADNSKNTAYLQMNSLKPEDTAVYYCAAFD<br>GGSGTQWGQGTLVTVSS |
| 5-46 | 1929 | EVQLVESGGGLVQPGGSLRLSCAASGEEFSDHWMGWFRQAPGKEREFVA<br>AIHWSGDSTHRNYADSVKGRFTISADNSKNTAYLQMNSLKPEDTAVYYC<br>ATVGITLNWGQGTLVTVSS |
| 5-47 | 1930 | EVQLVESGGGLVQPGGSLRLSCAASGFTFGSYDMGWFRQAPGKEREFVT<br>AINWSGARTAYADSVKGRFTISADNSKNTAYLQMNSLKPEDTAVYYCAA<br>RSVYSYEYNWGQGTLVTVSS |
| 5-48 | 1931 | EVQLVESGGGLVQPGGSLRLSCAASGLPLDLYAMGWFPPAPGKELEFVAG<br>IRWSDAYTEYADSVKGRFTINADNSKNPANLQMNSLKPEDTAVYYCALDI<br>DYRHWGQGTLVTVSS |
| 5-49 | 1932 | EVQLVESGGGLVQPGGSLRLSCAASGRTSTVNGMGWFRQAPGKEREFVA<br>SISQSGAATAYADSVKGRFTISADNSKNTAYLQMNSLKPEDTAVYYCAAD<br>RTYSYSSTGYYWGQGTLVTVSS |
| 5-50 | 1933 | EVQLVESGGGLVQPGGSLRLSCAASGFSLDYYGMGWFRQAPGKEREFVA<br>AITSGGTPHYADSVKGRFTISADNSKNTAYLQMNSLKPEDTAVYYCASAY<br>NPGIGYDWGQGTLVTVSS |
| 5-51 | 1934 | EVQLVESGGGLVQPGGSLRLSCAASGRPNSINWMGWFRQAPGKERQFVA<br>TITPGGNTNYADSVKGRFTISADNSKNTAYLLMNSLKPEDTAVYYCAAAA<br>GTTWYGTLYEYDWGQGTLVTVSS |
| 5-52 | 1935 | EVQLVESGGGLVQPGGSLRLSCAASGEKFSDHWMGWFRQAPGKEREFVA<br>TITFSGARTAYADSVKGRFTISADNSKNTAYLQMNSLKPEDTAVYYCAALI<br>KPSSTDRIFEEWGQGTLVTVSS |
| 5-53 | 1936 | EVQLVESGGGLVQPGGSLRLSCAASGLTVVPYAMGWFRQAPGKEREFVA<br>AIRRSAVTNYADSVKGRFTIIADNSKNTAYLLMNSLKPEDTAVYYCAARR<br>WGYHYWGQGTLVTVSS |
| 5-54 | 1937 | EVQLVESGGGLVQPGGSLRLSCAASGTTFNFNVMGWFRQAPGKERELVA<br>VISWTGESTLYADSVKGRFTISADNSKNTAYLQMNSLKPEDTAVYYCAAF<br>DGYTGRDWGQGTLVTVSS |
| 5-55 | 1938 | EVQLVESGGGLVQPGGSLRLSCAASGIDVNRNAMGWFRQAPGKEREFVA<br>AITWSGGWRYYADSVKGRFTISADNSKNTAYLQMNSLKPEDTAVYYCAT<br>TFGDAGIPDQYDFGWGQGTLVTVSS |
| 5-56 | 1939 | EVQLVESGGGLVQPGGSLRLSCAASGRTFSSNMGWFRQAPGKEREFVARI<br>FGGDRTLYADSVKGRFTISADNSKNTAYLQMNSLKPEDTAVYYCADING<br>DWGQGTLVTVSS |
| 5-57 | 1940 | EVQLVESGGGLVQPGGSLRLSCAASGGTFSMGWIRWVPQAQGKELEFMG<br>CIGWITYYADYAKSRFSLFTDNADNTKNPPNMHMNPQKPEDTAVYYCAP<br>FGWGQGTLVTVSS |
| 5-58 | 1941 | EVQLVESGGGLVQPGGSLRLSCAASGCTLDYYAMGWFRQAPGKEREFVA<br>GIRWTDAYTEYADSVKGRFTISADNSKNTAYLQMNSLKPEDTAVYYCAA<br>DVSPSYGGRWYWGQGTLVTVSS |
| 5-59 | 1942 | EVQLVESGGGLVQPGGSLRLSCAASGLTFSLYRMCWFRQAPGKEREEVSC<br>ISNIDGSTYYADSVKGRFTISADNSKNTAYLQMNSLKPEDTAVYYCAADL<br>LGDSDYEPSSGFGWGQGTLVTVSS |
| 5-60 | 1943 | EVQLVESGGGLVQPGGSLRLSCAASGRSFSSHRMGWFRQAPGKEREFVA<br>AIMWSGSHRNYADSVKGRFTISADNSKNTAYLQMNSLKPEDTAVYYCAA<br>IAYEEGVYRWDWGQGTLVTVSS |

TABLE 24-continued

SARS-CoV-2 S1 Variant Variably Heavy Chain

| Name | SEQ ID NO | Amino Acid Sequence |
|---|---|---|
| 5-61 | 1944 | EVQLVESGGGLVQPGGSLRLSCAASGRIIVPNTMGWFRQAPGKERERVTGISPSAFTEYADSVKGRFTISADNSKNTAYLQMNSLKPEDTAVYYCAAHGWGCHWGQGTLVTVSS |
| 5-62 | 1945 | EVQLVESGGGLVQPGGSLRLSCAASGSIFIISMGWFRQAPGKEHEFVTGINWSGGSTTYADSVKGRFTINADNSKNTAYLQMNSLKPEDTAVYYCAASAIGSGALRRFEYDWGQGTLVTVSS |
| 5-63 | 1946 | EVQLVESGGGLVQPGGSLRLSCAASGFSLDYYDMGWFRQAPGKEREFVAALGWSGGSTDYADSVKGRFTISADNSKNTAYLQMNSLKPEDTAVYYCAAGNGGRYGIVERWGQGTLVTVSS |
| 5-64 | 1947 | EVQLVESGGGLVQPGGSLRLSCAASGTSISNRVMGWFRQAPGKERELVARIYTGGDTLYADSVKGRFTISADNSKNTAYLQMNSLKPEDTAVYYCAARKIYRSLSYYGDYDWGQGTLVTVSS |
| 5-65 | 1948 | EVQLVESGGGLVQPGGSLRLSCAASGNIDRLYAMGWFRQAPGKEREGVAAIDSDGSTDYADSVKGRFTISADNSKNTAYLQMNSLKPEDTAVYYCAALIDYGLGFPIEWGQGTLVTVSS |
| 5-66 | 1949 | EVQLVESGGGLVQPGGSLRLSCAASGNTFTINVMGWFRQAPGKEREFVAAINWNGGTTLYADSVKGRFTISADNSKNTAYLQMNSLKPEDTAVYYCAAFDGYSGIDWGQGTLVTVSS |
| 5-67 | 1950 | EVQLVESGGGLVQPGGSLRLSCAASGFNVNDYAMGWFRQAPGKEREFVAGITSSVGVTNYADSVKGRFTISADNSKNTAYLQMNSLKPEDTAVYYCAADIFFVNWGRGTLVTVSS |
| 5-68 | 1951 | EVQLVESGGGLVQPGGSLRLSCAASGFTFDHYTMGWFRQAPGKEREFVAAISGSENVTSYADSVKGRFTISADNSKNTAYLQMNSLKPEDTAVYYCAAEPYIPVRTMRHMTFLTWGQGTLVTVSS |
| 6-1 | 1952 | EVQLVESGGGLVQPGGSLRLSCAASGRTFGNYNMGWFRQAPGKEREFVATINSLGGTSYADSVKGRFTISADNSKNTAYLQMNSLKPEDTAVYYCARVDYYMDVWGQGTLVTVSS |
| 6-2 | 1953 | EVQLVESGGGLVQPGGSLRLSCAASGFTMSSSWMGWFRQAPGKEREFVTVISGVGTSYADSVKGRFTISADNSKNTAYLQMNSLKPEDTAVYYCARGPDSSGYGFDYWGQGTLVTVSS |
| 6-3 | 1954 | EVQLVESGGGLVQPGGSLRLSCAASGFTFSPSWMGWFRQAPGKEREFVATINEYGGRNYADSVKGRFTISADNSKNTAYLQMNSLKPEDTAVYYCARVDRDFDYWGQGTLVTVSS |
| 6-4 | 1955 | EVQLVESGGGLVQPGGSLRLSCAASGFTRDYYTMGWFRQAPGKEREFVAAISRSGSLTSYADSVKGRFTISADNSKNTAYLQMNSLKPEDTAVYYCANLAYYDSSGYYDYWGQGTLVTVSS |
| 6-5 | 1956 | EVQLVESGGGLVQPGGSLRLSCAASGRTFTMGWFRQAPGKEREFVASTNSAGSTNYADSVNGRFTISADNSKNTAYLQMNSLKPEDTAVYYCTTVDQYFDYWGQGTLVTVSS |
| 6-6 | 1957 | EVQLVESGGGLVQPGGSLRLSCAASGTTLDYYAMGWFRQAPGKERELVAAISWSGGSTAYADSVKGRFTISADNSKNTAYLQMNSLKPEDTAVYYCAREDYYDSSGYSWGQGTLVTVSS |
| 6-7 | 1958 | EVQLVESGGGLVQPGGSLRLSCAASGFTFSSYWMGWFRQAPGKEREFVATINWSGVTAYADSVKGRFTISADNSKNTAYLQMNSLKPEDTAVYYCARADDYFDYWGQGTLVTVSS |
| 6-8 | 1959 | EVQLVESGGGLVQPGGSLRLSCAASGFTLSGIWMGWFLQAPGKEHEFVAIITTGGRTTYADSXKGRFTSSSDNSKNTAYLQMNLLKPEDTAEYYCAGYSTFGSSSAYYYYSMDVGWGQGTLVTVSS |
| 6-9 | 1960 | EVQLVESGGGLVQPGGSLRLSCAASGFTFDYYAMGWFRQAPGKEREFVSAIDSEGRTSYADSVKGRFTISADNSKNTAYLQMNSLKPEDTAVYYCARWGPFDIWGQGTLVTVSS |
| 6-10 | 1961 | EVQLVESGGGLVQPGGSLRLSCAASGSIASIHAMGWFRQAPGKEREFVAAISRSGGFGSYADSVKGRFTISADNSKNTAYLQMNSLKPEDTAVYYCARDDKYYDSSGYPAYFQHWGQGTLVTVSS |

TABLE 24-continued

| SARS-CoV-2 S1 Variant Variably Heavy Chain | | |
|---|---|---|
| Name | SEQ ID NO | Amino Acid Sequence |
| 6-11 | 1962 | EVQLVESGGGLVQPGGSLRLSCAASGLAFNAYAMGWFRQAPGKEREEVA TIGWSGANTYYADSVKGRFTISADNSKNTAYLQMNSLKPEDTAVYYCAS DPPGWGQGTLVTVSS |
| 6-12 | 1963 | EVQLVESGGGLVQPGGSLRLSCAASGSTYTTYSMGWFRQAPGKEREFVA AISGSENVTSYADSVKGRFTISADNSKNTAYLQMNSLKPEDTAVYYCARV DDYMDVWGQGTLVTVSS |
| 6-13 | 1964 | EVQLVESGGGLVQPGGSLRLSCAASGLTFNDYAMGWFRQAPGKEREFVA HIPRSTYSPYYADSVKGRFTISADNSKNTAYLQMNSLKPEDTAVYYCAFL VGPQGVDHGAFDVWGQGTLVTVSS |
| 6-14 | 1965 | EVQLVESGGGLVQPGGSLRLSCAASGITFRFKAMGWFRQAPGKEREFVAA VSWDGRNTYYADSVKGRFTISADNSKNTAYLQMNSLKPEDTAVYYCASD YYYMDVWGQGTLVTVSS |
| 6-15 | 1966 | EVQLVESGGGLVQPGGSLRLSCAASGSTVLINAMGWFRQAPGKEREFVA AVRWSDDYTYYADSVKGRFTISADNSKNTAYLQMNSLKPEDTAVYYCA KEGRAGSLDYWGQGTLVTVSS |
| 6-16 | 1967 | EVQLVESGGGLVQPGGSLRLSCAASGFTFDDAAMGWFRQAPGKEREFVA HISWSGGSTYYADSVKGRFTISADNSKNTAYLQMNSLKPEDTAVYYCATF GATVTATNDAFDIWGQGTLVTVSS |
| 6-17 | 1968 | EVQLVESGGGLVQPGGSLRLSCAASGNTGSTGYMGWFRQAPGKEREMV AGVINDGSTVYADSVKGRFTISADNSKNTAYLQMNSLKPEDTAVYYCAR LATSHQDGTGYLFDYWGQGTLVTVSS |
| 6-18 | 1969 | EVQLVESGGGLVQPGGSLRLSCAASGLTFRNYAMGWFRQAPGKEREFIAG MMWSGGTTTYADSVKGRFTISADNSKNTAYLQMNSLKPEDTAVYYCAR EGYYYDSSGYLNYFDYWGQGTLVTVSS |
| 6-19 | 1970 | EVQLVESGGGLVQPGGSLRLSCAASGSILSIAVMGWFRQAPGKEREFVAAI SPSAVTTYYADSVKGRFTISADNSKNTAYLQMNSLKPEDTAVYYCAIGYY DSSGYFDYWGQGTLVTVSS |
| 6-20 | 1971 | EVQLVESGGGLVQPGGSLRLSCAASGSTLPYHAMGWFRQAPGKEREFVA AITWNGASTSYADSVKGRFTISADNSKNTAYLQMNSLKPEDTAVYYCAR DRYYDTSASYFESETWGQGTLVTVSS |
| 6-21 | 1972 | EVQLVESGGGLVQPGGSLRLSCAASGTLFKINAMGWFRQAPGKEREFVA AITSSGSNIDYTYYADSVKGRFTISADNSKNTAYLQMNSLKPEDTAVYYC ARSNTGWYSFDYWGQGTLVTVSS |
| 6-22 | 1973 | EVQLVESGGGLVQPGGSLRLSCAASGRTFSEVVMGWFRQAPGKEREFVA TIHSSGSTSYADSVKGRFTISADNSKNTAYLQMNSLKPEDTAVYYCVRVT SDYSMDSWGQGTLVTVSS |
| 6-23 | 1974 | EVQLVESGGGLVQPGGSLRLSCAASGSIFSMNTMGWFRQAPGKEREFVAL INRSGGGINYADSVKGRFTISADNSKNTAYLQMNSLKPEDTAVYYCVRLS SGYYDFDYWGQGTLVTVSS |
| 6-24 | 1975 | EVQLVESGGGLVQPGGSLRLSCAASGFTLDYYAMGWFRQAPGKEREFVA AINWSGDNTHYADSVKGRFTISADNSKNTAYLQMNSLKPEDTAVYYCAR APFYCTTTKCQDNYYYMDVWGQGTLVTVSS |
| 6-25 | 1976 | EVQLVESGGGLVQPGGSLRLSCAASGLTFGTYTMGWFRQAPGKEREFVA AISRFGSTYYADSVKGRFTISADNSKNTAYLQMNSLKPEDTAVYYCARGG DYDFWSVDYMDVWGQGTLVTVSS |
| 6-26 | 1977 | EVQLVESGGGLVQPGGSLRLSCAASGDTFSTSWMGWFRQAPGKEREFVA TINTGGGTNYADSVKGRFTISADNSKNTAYLQMNSLKPEDTAVYYCARVT TSFDYWGQGTLVTVSS |
| 6-27 | 1978 | EVQLVESGGGLVQPGGSLRLSCAASGITFRFKAMGWFRQAPGKEREFVAS ISRSGTTYYADSVKGRFTISADNSKNTAYLQMNSLKPEDTAVYYCATDYS AFDMWGQGTLVTVSS |
| 6-28 | 1979 | EVQLVESGGGLVQPGGSLRLSCAASGDTYGSYWMGWFRQAPGKEREFV ATITSDDRTNYADSVKGRFTISADNSKNTAYLQMNSLKPEDTAVYYCARV TSSLSGMDVWGQGTLVTVSS |

TABLE 24-continued

SARS-CoV-2 S1 Variant Variably Heavy Chain

| Name | SEQ ID NO | Amino Acid Sequence |
|---|---|---|
| 6-29 | 1980 | EVQLVESGGGLVQPGGSLRLSCAASGYTLKNYYAMGWFRQAPGKERXL VAAIIWTGESTLDADSVKGRFTISADNSKNTAYLQMNSLKPEDTAVYYCA REGYYDSSGYYWGQGTLVTVSS |
| 6-30 | 1981 | EVQLVESGGGLVQPGGSLRLSCAASGFAFGDSWMGWFRQAPGKEREFVA TINWSGVTAYADSVKGRFTISADNSKNTAYLQMNSLKPEDTAVYYCARA DGYFDYWGQGTLVTVSS |
| 6-31 | 1982 | EVQLVESGGGLVQPGGSLRLSCAASGDTFSANRMGWFRQAPGKEREFVA SITWSSANTYYADSVKGRFTISADNSKNTAYLQMNSLKPEDTAVYYCATF NWNDEGFDFWGQGTLVTVSS |
| 6-32 | 1983 | EVQLVESGGGLVQPGGSLRLSCAASGFTLDYYDMGWFRQAPGKEREFVA LISWSGGSTYYADSVKGRFTISADNSKNTAYLQMNSLKPEDTAVYYCATD FYGWGTRERDAFDIWGQGTLVTVSS |
| 6-33 | 1984 | EVQLVESGGGLVQPGGSLRLSCAASGTFQRINHMGWFRQAPGKEREFVAT INTGGQPNYADSVKGRFTISADNSKNTAYLQMNSLKPEDTAVYYCASLIA AQDYYFDYWGQGTLVTVSS |
| 6-34 | 1985 | EVQLVESGGGLVQPGGSLRLSCAASGSAFRSNAMGWFRQAPGKEREFVA HISWSSKSTYYADSVKGRFTISADNSKNTAYLQMNSLKPEDTAVYYCATY CSSTSCFDYWGQGTLVTVSS |
| 6-35 | 1986 | EVQLVESGGGLVQPGGSLRLSCAASGFTLAYYAMGWFRQAPGKEREFVA AISMSGDDTIYADSVKGRFTISADNSKNTAYLQMNSLKPEDTAVYYCARE LGYSSTVWPWGQGTLVTVSS |
| 6-36 | 1987 | EVQLVESGGGLVQPGGSLRLSCAASGFDFSVSWMGWFRQAPGKEREFVT AITWSGDSTNYADSVKGRFTISADNSKNTAYLQMNSLKPEDTAVYYCASL LHTGPSGGNYFDYWGQGTLVTVSS |
| 6-37 | 1988 | EVQLVESGGGLVQPGGSLRLSCAASGHTFSTSWMGWFRQAPGKEREFVA TINSLGGTNYADSVKGRFTISADNSKNTAYLQMNSLKPEDTAVYYCARVS SGDYGMDVWGQGTLVTVSS |
| 6-38 | 1989 | EVQLVESGGGLVQPGGSLRLSCAASGNTFSGGFMGWFRQAPGKEREFVA VISSLSSKSYADSVKGRFTISADNSKNTAYLQMNSLKPEDTAVYYCAKVD SGYDYWGQGTLVTVSS |
| 6-39 | 1990 | EVQLVESGGGLVQPGGSLRLSCAASGFTFSPSWMGWFRQAPGKEREFVA AISWSGGSTAYADSVKGRFTISADNSKNTAYLQMNSLKPEDTAVYYCHGL GEGDPYGDYEGYFDLWGQGTLVTVSS |
| 6-40 | 1991 | EVQLVESGGGLVQPGGSLRLSCAASGFTFSDYWMGWFRQAPGKERELVA RVWWNGGSAYYADSVKGRFTISADNSKNTAYLQMNSLKPEDTAVYYCA REVLRQQVVLDYWGQGTLVTVSS |
| 6-41 | 1992 | EVQLVESGGGLVQPGGSLRLSCAASGFTFSTSWMGWFRQAPGKEREFVA SINEYGGRNYADSVKGRFTISADNSKNTAYLQMNSLKPEDTAVYYCAGL HYYYDSSGYNPTEYYGMDVWGQGTLVTVSS |
| 6-42 | 1993 | EVQLVESGGGLVQPGGSLRLSCAASGDTYGSYWMGWFRQAPGKEREFV AVITSGGSTNYADSVKGRFTISADNSKNTAYLQMNSLKPEDTAVYYCTHV QNSYYYAMDVWGQGTLVTVSS |
| 6-43 | 1994 | EVQLVESGGGLVQPGGSLRLSCAASGRTFSSYAMMGWFRQAPGKEREFV ASVNWDASQINYADSVKGRFTISADNSKNTAYLQMNSLKPEDTAVYYCT TLGAVYFDSSGYHDYFDYWGQGTLVTVSS |
| 6-44 | 1995 | EVQLVESGGGLVQPGGSLRLSCAASGGTFGVYHMGWFRQAPGKEREFIG RITWTDGSTYYADSVKGRFTISADNSKNTAYLQMNSLKPEDTAVYYCFGL LEVYDMTFDYWGQGTLVTVSS |
| 6-45 | 1996 | EVQLVESGGGLVQPGGSLRLSCAASGNMFSINAMGWFRQAPGKEREFVT LISWSSGRTSYADSVKGRFTISADNSKNTAYLQMNSLKPEDTAVYYCASL GYCSGGSCFDYWGQGTLVTVSS |
| 6-46 | 1997 | EVQLVESGGGLVQPGGSLRLSCAASGLTFSAMGWFRQAPGKEREFVALIR RDGSTIYADSVKGRFTISADNSKNTAYLQMNSLKPEDTAVYYCAALGILF GYDAFDIWGQGTLVTVSS |

TABLE 24-continued

SARS-CoV-2 S1 Variant Variably Heavy Chain

| Name | SEQ ID NO | Amino Acid Sequence |
|---|---|---|
| 6-47 | 1998 | EVQLVESGGGLVQPGGSLRLSCAASGRTFSMHAMGWFRQAPGKERELVA SITYGGNINYADSVKGRFTISADNSKNTAYLQMNSLKPEDTAVYYCAKEG YYDSTGYRTYFQQWGQGTLVTVSS |
| 6-48 | 1999 | EVQLVESGGGLVQPGGSLRLSCAASGFTVSNYAMGWFRQAPGKEREFVA SVNWSGGTTSYADSVKGRFTISADNSKNTAYLQMNSLKPEDTAVYYCAT TGTVTLGYWGQGTLVTVSS |
| 6-49 | 2000 | EVQLVESGGGLVQPGGSLRLSCAASGSTVLINAMGWFRQAPGKEREFVA AISWSPGRTDYADSVKGRFTISADNSKNTAYLQMNSLKPEDTAVYYCARD CSGGSCYSGDYWGQGTLVTVSS |
| 6-50 | 2001 | EVQLVESGGGLVQPGGSLRLSCAASGFSFDRWAMGWFRQAPGKEREWV ASLATGGNTNYADSVKGRFTISADNSKNTAYLQMNSLKPEDTAVYYCAR VTNYDAFDIWGQGTLVTVSS |
| 6-51 | 2002 | EVQLVESGGGLVQPGGSLRLSCAASGYTYSSYVMGWFRQAPGKEREFVA AISRFGSTYYADSVKGRFTISADNSKNTAYLQMNSLKPEDTAVYYCARDS GEHFWDSGYIDHWGQGTLVTVSS |
| 6-52 | 2003 | EVQLVESGGGLVQPGGSLRLSCAASGDTYGSYWMGWFRQAPGKEREVV AAITSGGSTVYADSVKGRFTISADNSKNTAYLQMNSLKPEDTAVYYCARV DSRFDYWGQGTLVTVSS |
| 6-53 | 2004 | EVQLVESGGGLVQPGGSLRLSCAASGISINTNVMGWFRQAPGKEREFVAA ISTGGSVTIYADSVKGRFTISADNSKNTAYLQMNSLKPEDTAVYYCARVDD FGYFDLWGQGTLVTVSS |
| 6-54 | 2005 | EVQLVESGGGLVQPGGSLRLSCAASGFEFENHWMGWFRQAPGKEREYVA HITAGGLSNYADSVKGRFTISADNSKNTAYLQMNSLKPEDTAVYYCGRH WGIYDSSGFSSFDYWGQGTLVTVSS |
| 6-55 | 2006 | EVQLVESGGGLVQPGGSLRLSCAASGFTMSSSWMGWFRQAPGKEREFVA RITSGGSTGYADSVKGRFTISADNSKNTAYLQMNSLKPEDTAVYYCASVD GYFDYWGQGTLVTVSS |
| 6-56 | 2007 | EVQLVESGGGLVQPGGSLRLSCAASGNIFRSNMGWFRQAPGKEREFVAGI TWNGDTTYYADSVKGRFTISADNSKNTAYLQMNSLKPEDTAVYYCARAL GVTYQFDYWGQGTLVTVSS |
| 6-57 | 2008 | EVQLVESGGGLVQPGGSLRLSCAASGLTFDDHSMGWFRQAPGKEREFVA AVPLSGNTYYADSVKGRFTISADNSKNTAYLQMNSLKPEDTAVYYCASFS GGPADFDYWGQGTLVTVSS |
| 6-58 | 2009 | EVQLVESGGGLVQPGGSLRLSCAASGRAVSTYAMGWFRQAPGKEREFVA AISGSENVTSYADSVKGRFTISADNSKNTAYLQMNSLKPEDTAVYYCLSV TGDTEDYGVFDTWGQGTLVTVSS |
| 6-59 | 2010 | EVQLVESGGGLVQPGGSLRLSCAASGISGSVFSRTPMGWFRQAPGKEREW VSSIYSDGSNTYYADSVKGRFTISADNSKNTAYLQMNSLKPEDTAVYYCA HWSWELGDWFDPWGQGTLVTVSS |
| 6-60 | 2011 | EVQLVESGGGLVQPGGSLRLSCAASGDTYGSYWMGWFRQAPGKEREFV ATISQSGAATAYADSVKGRFTISADNSKNTAYLQMNSLKPEDTAVYYCAG LLRYSGTYYDAFDVWGQGTLVTVSS |
| 6-61 | 2012 | EVQLVESGGGLVQPGGSLRLSCAASGDTYGSYWMGWFRQAPGKEREFV AAINWSGGSTNYADSVKGRFTITADNNKNTAYLQMNSLKPEDTAVYYCA GLGWNYMDYWGQGTLVTVSS |
| 6-62 | 2013 | EVQLVESGGGLVQPGGSLRLSCAASGSTFSGNWMGWFRQAPGKEREFVA VISWTGGSTYYADSVKGRFTISADNSKNTAYLQMNSLKPEDTAVYYCAT HNSLSGFDYWGQGTLVTVSS |
| 6-63 | 2014 | EVQLVESGGGLVQPGGSLRLSCAASGQTFNMGWFRQAPGKEREFVAAIG SGGSTSYADSVKGRFTISADNSKNTAYLQMNSLKPEDTAVYYCWRLGND YFDYWGQGTLVTVSS |
| 6-64 | 2015 | EVQLVESGGGLVQPGGSLRLSCAASGIPSIHAMGWFRQAPGKERELVAAI NWSHGVTYYADSVKGRFTISADNSKNTAYLQMNSLKPEDTAVYYCGGG YGYHFDYWGQGTLVTVSS |

TABLE 24-continued

SARS-CoV-2 S1 Variant Variably Heavy Chain

| Name | SEQ ID NO | Amino Acid Sequence |
|---|---|---|
| 6-65 | 2016 | EVQLVESGGGLVQPGGSLRLSCAASGLPFSTLHMGWFRQAPGKEREFVAS LSIFGATGYADSVKGRFTISADNSKNTAYLQMNSLKPEDTAVYYCWMYY YDSSGYYGNYYYGMDVWGQGTLVTVSS |
| 6-66 | 2017 | EVQLVESGGGLVQPGGSLRLSCAASGLTFSLFAMGWFRQAPGKERELVA AISSGGSTDYADSVKGRFTISADNSKNTAYLQMNSLKPEDTAVYYCARGN TKYYYDSSGYSSAFDYWGQGTLVTVSS |
| 6-67 | 2018 | EVQLVESGGGLVQPGGSLRLSCAASGSFSNYAMGWFRQAPGKEREFVAAI SSSGALTSYADSVKGRFTISADNSKNTAYLQMNSLKPEDTAVYYCWIVGP GPLDGMDVWGQGTLVTVSS |
| 6-68 | 2019 | EVQLVESGGGLVQPGGSLRLSCAASGFTLSDRAMGWFRQAPGKEREYVA HITAGGLSNYADSVKGRFTISADNSKNTAYLQMNSLKPEDTAVYYCVHLA SQTGAGYFDLWGQGTLVTVSS |
| 6-69 | 2020 | EVQLVESGGGLVQPGGSLRLSCAASGGTFSSVGMGWFRQAPGKEREFVA GISRSGGTYYADSVKGRFTISADNSKNTAYLQMNSLKPEDTAVYYCARYD FWSGYPYWGQGTLVTVSS |
| 6-70 | 2021 | EVQLVESGGGLVQPGGSLRLSCAASGFNLDDYADMGWFRQAPGKEREFV AAIGWGGGSTRYADSVKGRFTISADNSKNTAYLQMNSLKPEDTAVYYCA REILWFGEFGEPNVWGQGTLVTVSS |
| 6-71 | 2022 | EVQLVESGGGLVQPGGSLRLSCAASGITFSNDAMGWFRQAPGKEREFVAII TSSDTNDTTNYADSVKGRFTISADNSKNTAYLQMNSLKPEDTAVYYCARL HYYDSSGYFDYWGQGTLVTVSS |
| 6-72 | 2023 | EVQLVESGGGLVQPGGSLRLSCAASGSTLSINAMGWFRQAPGKEREFVAA IDWSGGSTAYADSVKGRFTISADNSKNTAYLQMNSLKPEDTAVYYCARD SSATRTGPDYWGQGTLVTVSS |
| 6-73 | 2024 | EVQLVESGGGLVQPGGSLRLSCAASGHTFSGYAMGWFRQAPGKEREFVA VITREGSTYYADSVKGRFTISADNSKNTAYLQMNSLKPEDTAVYYCARLG GEGFDYWGQGTLVTVSS |
| 6-74 | 2025 | EVQLVESGGGLVQPGGSLRLSCAASGFAFGDSWMGWFRQAPGKERELVA AITSGGSTDYADSVKGRFTISADNSKNTAYLQMNSLKPEDTAVYYCARGL LWFGELFGYWGQGTLVTVSS |
| 6-75 | 2026 | EVQLVESGGGLVQPGGSLRLSCAASGGTFSTYWMGWFRQAPGKEREFVA AISRSGGNTYYADSVKGRFTISADNSKNTAYLQMNSLKPEDTAVYYCVRH SGTDGDSSFDYWGQGTLVTVSS |
| 6-76 | 2027 | EVQLVESGGGLVQPGGSLRLSCAASGLAFDFDGMGWFRQAPGKEREGVA AINSGGSTYYADSVKGRFTISADNSKNTAYLQMNSLKPEDTAVYYCARFF RAHDYWGQGTLVTVSS |
| 6-77 | 2028 | EVQLVESGGGLVQPGGSLRLSCAASGFTFDRSWMGWFRQAPGKEREFVA AVTEGGTTSYADSVKGRFTISADNSKNTAYLQMNSLKPEDTAVYYCARA DYDFDYWGQGTLVTVSS |
| 6-78 | 2029 | EVQLVESGGGLVQPGGSLRLSCAASGRTYDAMGWFRQAPGKEREFVASV TSGGYTHYADSVKGRFTISADNSKNTAYLQMNSLKPEDTAVYYCAKFGR KIVGATELDYWGQGTLVTVSS |
| 6-79 | 2030 | EVQLVESGGGLVQPGGSLRLSCAASGSISSIDYMGWFRQAPGKEREGVSW ISSSDGSTYYADSVKGRFTISADNSKNTAYLQMNSLKPEDTAVYYCARSPS FSQIYYYYYMDVWGQGTLVTVSS |
| 6-80 | 2031 | EVQLVESGGGLVQPGGSLRLSCAASGGTFSFYNMGWFRQAPGKEREFVA FISGNGGTSYADSVKGRFTISADNSKNTAYLQMNSLKPEDTAVYYCAVVA MRMVTTEGPDVLDVWGQGTLVTVSS |
| 6-81 | 2032 | EVQLVESGGGLVQPGGSLRLSCAASGFIGNYHAMGWFRQAPGKEREFVA AVTWSGGTTNYADSVKGRFTISADNSKNTAYLQMNSLKPEDTAVYYCAR EGYYYDSSGYPYYFDYWGQGTLVTVSS |
| 6-82 | 2033 | EVQLVESGGGLVQPGGSLRLSCAASGSSLDAYGMGWFRQAPGKEREFVA AISWGGGSIYYADSVKGRFTISADNSKNTAYLQMNSLKPEDTAVYYCARL SQGMVALDYWGQGTLVTVSS |

TABLE 24-continued

| SARS-CoV-2 S1 Variant Variably Heavy Chain | | |
|---|---|---|
| Name | SEQ ID NO | Amino Acid Sequence |
| 6-83 | 2034 | EVQLVESGGGLVQPGGSLRLSCAASGSIASIHAMGWFRQAPGKEREFVAA ITWSGAITSYADSVKGRFTISADNSKNTAYLQMNSLKPEDTAVYYCAKDG GYGELHYGMEVWGQGTLVTVSS |
| 6-84 | 2035 | EVQLVESGGGLVQPGGSLRLSCAASGFTPDDYAMGWFRQAPGKEREFVA AINSGGSYTYYADSVKGRFTISADNSKNTAYLQMNSLKPEDTAVYYCARD RGPWGQGTLVTVSS |
| 6-85 | 2036 | EVQLVESGGGLVQPGGSLRLSCAASGGTFSVFAMGWFRQAPGKEREFVS AINWSGGSLLYADSVKGRFTISADNSKNTAYLQMNSLKPEDTAVYYCALF GDFDYWGQGTLVTVSS |
| 6-86 | 2037 | EVQLVESGGGLVQPGGSLRLSCAASGPISGINRMGWFRQAPGKEREFVAV ITSNGRPSYADSVKGRFTISADNSKNTAYLQMNSLKPEDTAVYYCVRLSS GYFDFDYWGQGTLVTVSS |
| 6-87 | 2038 | EVQLVESGGGLVQPGGSLRLSCAASGTSIMVGAMGWFRQAPGKEREFVAI IRGDGRTSYADSVKGRFTISADNSKNTAYLQMNSLKPEDTAVYYCARFAG WDAFDIWGQGTLVTVSS |
| 6-88 | 2039 | EVQLVESGGGLVQPGGSLRLSCAASGRTFSTHWMGWFRQAPGKEREFVA VINWSGGSIYYADSVKGRFTISADNSKNTAYLQMNSLKPEDTAVYYCARL SSDGYNYFDFWGQGTLVTVSS |
| 6-89 | 2040 | EVQLVESGGGLVQPGGSLRLSCAASGTIFASAMGWFRQAPGKEHQFVAV VNWNGSSTVYADNVKGRFTIIADNSKNTAYLQMNSLKPEDTAVYYCTTV DQYFNYWGQGTLVTVSS |
| 6-90 | 2041 | EVQLVESGGGLVQPGGSLRLSCAASGFPFSIWPMGWFRQAPGKEREFVAA VRWSSTYYADSVKGRFTISADNSKNTAYLQMNSLKPEDTAVYYCATGEC DGGSCSLAYWGQGTLVTVSS |
| 6-91 | 2042 | EVQLVESGGGLVQPGGSLRLSCAASGRTFGNYAMGWFRQAPGKEREFVA SISSSGVSKHYADSVKGRFTISADNSKNTAYLQMNSLKPEDTAVYYCVRF GSSWARDLDQWGQGTLVTVSS |
| 6-92 | 2043 | EVQLVESGGGLVQPGGSLRLSCAASGFLFDSYASMGWFRQAPGKEREFV ATIWRRGNTYYANYADSVKGRFTISADNSKNTAYLQMNSLKPEDTAVYY CTETGTAAWGQGTLVTVSS |
| 6-93 | 2044 | EVQLVESGGGLVQPGGSLRLSCAASGLPFSTKSMGWFRQAPGKEREFVAA ISMSGLTSYADSVKGRFTISADNSKNTAYLQMNSLKPEDTAVYYCLKVLG GDYEADNWFDYWGQGTLVTVSS |
| 6-94 | 2045 | EVQLVESGGGLVQPGGSLRLSCAASGNIFRIETMGWFRQAPGKEREFVAGI IRSGGETLYADSVKGRFTISADNSKNTAYLQMNSLKPEDTAVYYCARSLY YDRSGSYYFDYWGQGTLVTVSS |
| 6-95 | 2046 | EVQLVESGGGLVQPGGSLRLSCAASGIPSSIRAMGWFRQAPGKEREFVAVI RWTGGSTYYADSVKGRFTISADNSKNTAYLQMNSLKPEDTAVYYCARDI GYYDSSGYYNDGGFDYWGQGTLVTVSS |
| 6-96 | 2047 | EVQLVESGGGLVQPGGSLRLSCAASGFTLSGNWMGWFRQAPGKEREFVA IITSGGRTNYADSVKGRFTISADNSKNTAYLQMNSLKPEDTAVYYCAGHA TFGGSSSSYYYGMDVWGQGTLVTVSS |
| 6-97 | 2048 | EVQLVESGGGLVQPGGSLRLSCAASGFTFSSLAMGWFRQAPGKEREFVAA ITWSGDITNYADSVKGRFTITADNSKNTAYLQMNSLKPEDTAVYYCLRLS SSGFDHWGQGTLVTVSS |
| 6-98 | 2049 | EVQLVESGGGLVQPGGSLRLSCAASGTFGHYAMGWFRQAPGKEREFVAA INWSSRSTVYADSVKGRFTITADNSKNTAYLQMNSLKPEDTAVYYCAKSD GLMGELRSASAFDIWGQGTLVTVSS |
| 6-99 | 2050 | EVQLVESGGGLVQPGGSLRLSCAASGIPFRSRTMGWFRQAPGKEREFVAG ISRSGASTAYADSVKGRFTISADNSKNTAYLQMNSLKPEDTAVYYCTHAN DYGDYWGQGTLVTVSS |
| 6-100 | 2051 | EVQLVESGGGLVQPGGSLRLSCAASGGTFSTSWMGWFRQAPGKEREYVA HITAGGLSNYADSVKGRFTISADNSKNTAYLQMNSLKPEDTAVYYCARLL VREDWYFDLWGQGTLVTVSS |

TABLE 24-continued

SARS-CoV-2 S1 Variant Variably Heavy Chain

| Name | SEQ ID NO | Amino Acid Sequence |
|---|---|---|
| 6-101 | 2052 | EVQLVESGGGLVQPGGSLRLSCAASGGTFSLFAMGWFRQAPGKEREFVA AISWTGDSTYYKYYADSVKGRFTISADNSKNTAYLQMNSLKPEDTAVYY CAYNNSSGEYWGQGTLVTVSS |
| 6-102 | 2053 | EVQLVESGGGLVQPGGSLRLSCAASGSSFSAYAMGWFRQAPGKEREFVS AIDSEGTTTYADSVKGRFTISADNSKNTAYLQMNSLKPEDTAVYYCAGDY NFWSGFDHWGQGTLVTVSS |
| 6-103 | 2054 | EVQLVESGGGLVQPGGSLRLSCAASGRTSSPIAMGWFRQAPGKEREPVAV RWSDDYTYYADSVKGRFTISADNSKNTAYLQMNSLKPEDTAVYYCAKKL GGYYAFDIWGQGTLVTVSS |
| 6-104 | 2055 | EVQLVESGGGLVQPGGSLRLSCAASGLTFNQYTMGWFRQAPGKEREFVA SITDGGSTYYADSVKGRFTISADNSKNTAYLQMNSLKPEDTAVYYCARDS RYMDVWGQGTLVTVSS |
| 6-105 | 2056 | EVQLVESGGGLVQPGGSLRLSCAASGPTFSSMGWFRQAPGKEREFVAAIS WDGGATAYADSVKGRFTISADNSKNTAYLQMNSLKPEDTAVYYCAIEIV VGGIYWGQGTLVTVSS |
| 6-106 | 2057 | EVQLVESGGGLVQPGGSLRLSCAASGIPSTLRAMGWFRQAPGKEREFVAA TSWSGGSKYYADSVKGRFTISADNSKNTAYLQMNSLKPEDTAVYYCATD LYYMDVWGQGTLVTVSS |
| 6-107 | 2058 | EVQLVESGGGLVQPGGSLRLSCAASGGVGFSVTNMGWFRQAPGKEREFV AVISSSSSTNYADSVKGRFTISADNSKNTAYLQMNSLKPEDTAVYYCTTFN WNDEGFDYWGQGTLVTVSS |
| 6-108 | 2059 | EVQLVESGGGLVQPGGSLRLSCAASGGTFGSYGMGWFRQAPGKEREFVA AIRWSGGITYYADSVKGRFTISADNSKNTAYLQMNSLKPEDTAVYYCARE RYWNPLPYYYYGMDVWGQGTLVTVSS |
| 6-109 | 2060 | EVQLVESGGGLVQPGGSLRLSCAASGGTFSTYAMGWFRQVPGKEREFVA SIDWSGLTSYADSVKGRFTISADNSKNTAYLQMNSLKPEDTAVYYCARGP FYMYCSGTKCYSTNWFDPWGQGTLVTVSS |
| 6-110 | 2061 | EVQLVESGGGLVQPGGSLRLSCAASGPIYAVNRMGWFRQAPGKEREFVA GIWRSGGHRDYADSVKGRFTISADNSKNTAYLQMNSLKPEDTAVYYCAR GEIDILTGYWYDYWGQGTLVTVSS |
| 6-111 | 2062 | EVQLVESGGGLVQPGGSLRLSCAASGFTFSNYWMGWFRQAPGKEREFVG GISRSGVSTSYADSVKGRFTISADNSKNTAYLQMNSLKPEDTAVYYCTTLL YYYDSSGYSFDAFDIWGQGTLVTVSS |
| 6-112 | 2063 | EVQLVESGGGLVQPGGSLRLSCAASGGTFSAYHMGWFRQAPGKERELVTI IDNGGPTSYADSVKGRFTISADNSKNTAYLQMNSLKPEDTAVYYCTALLY YFDNSGYNFDPFDIWGQGTLVTGSS |

TABLE 25

Reformatted SARS-CoV-2 S1 Variant Sequences

| Name | SEQ ID NO | Amino Acid Sequence |
|---|---|---|
| 2-H1 | 2064 | EVQLLESGGGLVQPGGSLRLSCAASGFTFSNYATDWVRQAPGKGLEWVSII SGSGGATYYADSVKGRFTISRDNSKNTLYLQMNSLRAEDTAVYYCAKGG YCSSDTCWWEYWLDPWGQGTLVTVSS |
| 2-H2 | 2065 | EVQLLESGGGLVQPGGSLRLSCAASGFTFSAFAMGWVRQAPGKGLEWVS AITASGDITYYADSVKGRFTISRDNSKNTLYLQMNSLRAEDTAVYYCARQS DGLPSPWHFDLGGQGTLVTVSS |
| 2-H3 | 2066 | EVQLLESGGGLVQPGGSLRLSCAASGFTFSDFAMAWVRQAPGKGLEWVS AISGSGDITYYADSVKGRFTISRDNSKNTLYLQMNSLRAEDTAVYYCAREA DGLHSPWHFDLWGQGTLVTVSS |

TABLE 25-continued

Reformatted SARS-CoV-2 S1 Variant Sequences

| Name | SEQ ID NO | Amino Acid Sequence |
|---|---|---|
| 2-H4 | 2067 | EVQLLESGGGLVQPGGSLRLSCAASGFTFSRHAMNWVRQAPGKGLEWVS<br>GISGSGDETYYADSVKGRFTISRDNSKNTLYLQMNSLRAEDTAVYYCARD<br>LPASYYDSSGYYWHNGMDVWGQGTLVTVSS |
| 2-H5 | 2068 | EVQLLESGGGLVQPGGSLRLSCAASGFTFSDFAMAWVRQAPGKGLEWVS<br>AISGSGDITYYADSVKGRFTISRDNSKNTLYLQMNSLRAEDTAVYYCAREA<br>DCLPSPWYLDLWGQGTLVTVSS |
| 2-H6 | 2069 | EVQLLESGGGLVQPGGSLRLSCAASGFTFSDFAMAWVRQAPGKGLEWVS<br>AISGSGDITYYADSVKGRFTISRDNSKNTLYLQMNSLRAEDTAVYYCAREA<br>DGLHSPWHFDLWGQGTLVTVSS |
| 2-H7 | 2070 | EVQLLESGGGLVQPGGSLRLSCAASGFTFSNYPMNWVRQAPGKGLEWVST<br>ISGSGGNTFYADSVKGRFTISRDNSKNTLYLQMNSLRAEDTAVYYCVRHD<br>EYSFDYWGQGTLVTVSS |
| 2-H8 | 2071 | EVQLLESGGGLVQPGGSLRLSCAASGFTFSDFAMAWVRQAPGKGLEWVS<br>AITGSGDITYYADSVKGRFTISRDNSKNTLYLQMNSLRAEDTAVYYCAREA<br>DGLHSPWHFDLWGQGTLVTVSS |
| 2-H9 | 2072 | EVQLLESGGGLVQPGGSLRLSCAASGFTFSDYPMNWVRQAPGKGLEWVST<br>ISGSGGITFYADSVKGRFTISRDNSKNTLYLQMNSLRAEDTAVYYCVRHDE<br>YSFDYWGQGTLVTVSS |
| 2-H10 | 2073 | EVQLLESGGGLVQPGGSLRLSCAASGFTFSDYPMNWVRQAPGKGLEWVS<br>AISGSGDNTYYADSVKGRFTISRDNSKNTLYLQMNSLRAEDTAVYYCVRH<br>DEYSFDYWGQGTLVTVSS |
| 2-H11 | 2074 | EVQLLESGGGLVQPGGSLRLSCAASGFTFSDFAMAWVRQAPGKGLEWVS<br>AITGTGDITYYADSVKGRFTISRDNSKNTLYLQMNSLRAEDTAVYYCAREA<br>DGLHSPWGQGTLVTVSS |
| 2-H12 | 2075 | EVQLLESGGGLVQPGGSLRLSCAASGFTFSDYPMNWVRQAPGKGLEWVS<br>AITGSGDITYYADSVKGRFTISRDNSKNTLYLQMNSLRAEDTAVYYCVRHD<br>EYSFDYWGQGTLVTVSS |
| 2-H13 | 2076 | EVQLLESGGGLVQPGGSLRLSCAASGFTFSDFAMAWVRQAPGKGLEWVS<br>AISGSGDITYYADSVKGRFTISRDNSKNTLYLQMNSLRAEDTAVYYCAREA<br>DGLHSPWHFDLWGQGTLVTVSS |
| 2-H14 | 2077 | EVQLLESGGGLVQPGGSLRLSCAASGFTFSDFAMAWVRQAPGKGLEWVS<br>AISGSGDITYYADSVKGRFTISRDNSKNTLYLQMNSLRAEDTAVYYCAREA<br>DGLHSPWHFDLWGQGTLVTVSS |
| 2-H15 | 2078 | EVQLLESGGGLVQPGGSLRLSCAASGFTFPRYAMSWVRQAPGKGLEWVST<br>ISGSGSTTYYADSVKGRFTISRDNSKNTLYLQMNSLRAEDTAVYYCARLID<br>AFDIWGQGTLVTVSS |
| 2-L1 | 2079 | DIQMTQSPSSLSASVGDRVTITCRASQSIHRFLNWYQQKPGKAPKLLIYAAS<br>NLHSGVPSRFSGSGSGTDFTLTISSLQPEDFATYYCQQSYGLPPTFGQGTKV<br>EIK |
| 2-L2 | 2080 | DIQMTQSPSSLSASVGDRVTITCRASQSIHISLNWYQQKPGKAPKLLIYLASP<br>LASGVPSRFSGSGSGTDFTLTISSLQPEDFATYYCQQSYSAPPYTFGQGTKV<br>EIK |
| 2-L3 | 2081 | DIQMTQSPSSLSASVGDRVTITCRASQSIHTYLNWYQQKPGKAPKLLIYAAS<br>ALASGVPSRFSGSGSGTDFTLTISSLQPEDFATYYCQQSYSAPPYTFGQGTK<br>VEIK |
| 2-L4 | 2082 | DIQMTQSPSSLSASVGDRVTITCRASQTINTYLNWYQQKPGKAPKLLIYSAS<br>TLQSGVPSRFSGSGSGTDFTLTISSLQPEDFATYYCQQSYSTFTFGQGTKVEI<br>K |
| 2-L5 | 2083 | DIQMTQSPSSLSASVGDRVTITCRASQNIHTYLNWYQQKPGKAPKLLIYAA<br>STFAKGVPSRFSGSGSGTDFTLTISSLQPEDFATYYCQQSYSAPPYTFGQGT<br>KVEIK |
| 2-L6 | 2084 | DIQMTQSPSSLSASVGDRVTITCRASQSIDTYLNWYQQKPGKAPKLLIYAAS<br>ALASGVPSRFSGSGSGTDFTLTISSLQPEDFATYYCQQSYSAPPYTFGQGTK<br>VEIK |

TABLE 25-continued

Reformatted SARS-CoV-2 S1 Variant Sequences

| Name | SEQ ID NO | Amino Acid Sequence |
|---|---|---|
| 2-L7 | 2085 | DIQMTQSPSSLSASVGDRVTITCRASQSIGNYLNWYQQKPGKAPKLLIYGV<br>SSLQSGVPSRFSGSGSGTDFTLTISSLQPEDFATYYCQQSHSAPLTFGQGTKV<br>EIK |
| 2-L8 | 2086 | DIQMTQSPSSLSASVGDRVTITCRASQSIDTYLNWYQQKPGKAPKLLIYAAS<br>ALASGVPSRFSGSGSGTDFTLTISSLQPEDFATYYCQQSYSAPPYTFGQGTK<br>VEIK |
| 2-L9 | 2087 | DIQMTQSPSSLSASVGDRVTITCRASQSIDNYLNWYQQKPGKAPKLLIYGV<br>SALQSGVPSRFSGSGSGTDFTLTISSLQPEDFATYYCQQSHSAPPYFFGQGT<br>KVEIK |
| 2-L10 | 2088 | DIQMTQSPSSLSASVGDRVTITCRASQSIDTYLNWYQQKPGKAPKLLIYGAS<br>ALESGVPSRFSGSGSGTDFTLTISSLQPEDFATYYCQQSHSAPPYFFGQGTK<br>VEIK |
| 2-L11 | 2089 | DIQMTQSPSSLSASVGDRVTITCRASQSIDTYLNWYQQKPGKAPKLLIYAAS<br>ALASGVPSRFSGSGSGTDFTLTISSLQPEDFATYYCQQSYSAPPYTFGQGTK<br>VEIK |
| 2-L12 | 2090 | DIQMTQSPSSLSASVGDRVTITCRASQSIDTYLNWYQQKPGKAPKLLIYGVS<br>ALQSGVPSRFSGSGSGTDFTLTISSLQPEDFATYYCQQSYSAPPYFFGQGTK<br>VEIK |
| 2-L13 | 2091 | DIQMTQSPSSLSASVGDRVTITCRASQSIDTYLNWYQQKPGKAPKLLIYAAS<br>ALASGVPSRFSGSGSGTDFTLTISSLQPEDFATYYCQQSYSAPPYTFGQGTK<br>VEIK |
| 2-L14 | 2092 | DIQMTQSPSSLSASVGDRVTITCRASQSIDNYLNWYQQKPGKAPKLLIYGV<br>SALQSGVPSRFSGSGSGTDFTLTISSLQPEDFATYYCQQSHSAPLTFGQGTK<br>VEIK |
| 2-L15 | 2093 | DIQMTQSPSSLSASVGDRVTITCRASQRIGTYLNWYQQKPGKAPKLLIYAA<br>SNLEGGVPSRFSGSGSGTDFTLTISSLQPEDFATYYCQQNYSTTWTFGQGTK<br>VEIK |
| 2-H16 | 2094 | EVQLLESGGGLVQPGGSLRLSCAASGFTFSSYAMSWVRQAPGKGLEWVSV<br>ISGSGGSTYYADSVKGRFTISRDNSKNTLYLQMNSLRAEDTAVYYCAREG<br>YRDYLWYFDLWGQGTLVTVSS |
| 2-H17 | 2095 | EVQLLESGGGLVQPGGSLRLSCAASGFTFSNYAMSWVRQAPGKGLEWVS<br>AISGSAGSTYYADSVKGRFTISRDNSKNTLYLQMNSLRAEDTAVYYCARV<br>RQGLRRTWYYFDYWGQGTLVTVSS |
| 2-H18 | 2096 | EVQLLESGGGLVQPGGSLRLSCAASGFTFSSYAMYWVRQAPGKGLEWVS<br>AISGSAGSTYYADSVKGRFTISRDNSKNTLYLQMNSLRAEDTAVYYCARD<br>TNDFWSGYSIFDPWGQGTLVTVSS |
| 2-H19 | 2097 | EVQLLESGGGLVQPGGSLRLSCAASGFTFSSYTMSWVRQAPGKGLEWVSV<br>ISGSGGSTYYADSVKGRFTISRDNSKNTLYLQMNSLRAEDTAVYYCAREG<br>YRDYLWYFDLWGQGTLVTVSS |
| 2-H20 | 2098 | EVQLLESGGGLVQPGGSLRLSCAASGFTFSSYDMSWVRQAPGKGLEWVSV<br>ISGSGGSTYYADSVKGRFTISRDNSKNTLYLQMNSLRAEDTAVYYCAKGPL<br>VGWYFDLWGQGTLVTVSS |
| 2-L16 | 2099 | DIQMTQSPSSLSASVGDRVTITCTGTSSDVGSYDLVSWYQQKPGKAPKLLI<br>YEGNKRPSGVPSRFSGSGSGTDFTLTISSLQPEDFATYYCCSYAGSSVVFGQ<br>GTKVEIK |
| 2-L17 | 2100 | DIQMTQSPSSLSASVGDRVTITCTGTSSDVGSSNLVSWYQQKPGKAPKLLIY<br>EGSKRPSGVPSRFSGSGSGTDFTLTISSLQPEDFATYYCCSYAGSLYVFGQG<br>TKVEIK |
| 2-L18 | 2101 | DIQMTQSPSSLSASVGDRVTITCTGTSSDIGSYNLVSWYQQKPGKAPKLLIY<br>EGTKRPSGVPSRFSGSGSGTDFTLTISSLQPEDFATYYCCSYAGSRTYVFGQ<br>GTKVEIK |
| 2-L19 | 2102 | DIQMTQSPSSLSASVGDRVTITCTGTSTDVGSYNLVSWYQQKPGKAPKLLI<br>YEGTKRPSGVPSRFSGSGSGTDFTLTISSLQPEDFATYYCCSYAGSYTSVVF<br>GQGTKVEIK |

TABLE 25-continued

Reformatted SARS-CoV-2 S1 Variant Sequences

| Name | SEQ ID NO | Amino Acid Sequence |
|---|---|---|
| 2-L20 | 2103 | DIQMTQSPSSLSASVGDRVTITCTGTSSNVGSYNLVSWYQQKPGKAPKLLI YEGTKRPSGVPSRFSGSGSGTDFTLTISSLQPEDFATYYCCSYAGSSSFVVFG QGTKVEIK |

TABLE 26

Reformatted ACE2 Variant Sequences

| Name | SEQ ID NO | Amino Acid Sequence |
|---|---|---|
| 3-H1 | 2104 | EVQLLESGGGLVQPGGSLRLSCAASGFTFRSHAMSWVRQAPGKGLEWVSSI SGGGASTYYADSVKGRFTISRDNSKNTLYLQMNSLRAEDTAVYYCARVKY LTTSSGWPRPYFDNWGQGTLVTVSS |
| 3-H2 | 2105 | EVQLLESGGGLVQPGGSLRLSCAASGFTFSAYSMSWVRQAPGKGLEWVSA ISGSGGSRYYADSVKGRFTISRDNSKNTLYLQMNSLRAEDTAVYYCGRSK WPQANGAFDIWGQGTLVTVSS |
| 3-H3 | 2106 | EVQLLESGGGLVQPGGSLRLSCAASGFMFGNYAMSWVRQAPGKGLEWVA AISGSGGSTYYADSVKGRFTISRDNSKNTLYLQMNSLRAEDTAVYYCAKDR GYSSSWYGGFDYWGQGTLVTVSS |
| 3-H4 | 2107 | EVQLLESGGGLVQPGGSLRLSCAASGFTFRNHAMAWVRQAPGKGLEWVS GISGSGGTTYYGDSVKGRFTISRDNSKNTLYLQMNSLRAEDTAVYYCARGT RFLQWSLPLDVWGQGTLVTVSS |
| 3-H5 | 2108 | EVQLLESGGGLVQPGGSLRLSCAASGFTIPNYAMSWVRQAPGKGLEWVSGI SGAGASTYYADSVKGRFTISRDNSKNTLYLQMNSLRAEDTAVYYCARHTW WKGAGFFDHWGQGTLVTVSS |
| 3-H6 | 2109 | EVQLLESGGGLVQPGGSLRLSCAASGFTFRNYAMAWVRQAPGKGLEWVS GISGSGGTTYYGDSVKGRFTISRDNSKNTLYLQMNSLRAEDTAVYYCARGT RFLEWSLPLDVWGQGTLVTVSS |
| 3-H7 | 2110 | EVQLLESGGGLVQPGGSLRLSCAASGFTIRNYAMSWVRQAPGKGLEWVSSI SGGGASTYYADSVKGRFTISRDNSKNTLYLQMNSLRAEDTAVYYCARVKY LTTSSGWPRPYFDNWGQGTLVTVSS |
| 3-H8 | 2111 | EVQLLESGGGLVQPGGSLRLSCAASGFTIPNYAMSWVRQAPGKGLEWVSGI SGSGASTYYADSVKGRFTISRDNSKNTLYLQMNSLRAEDTAVYYCARHTW WKGAGFFDHWGQGTLVTVSS |
| 3-H9 | 2112 | EVQLLESGGGLVQPGGSLRLSCAASGFTITNYAMSWVRQAPGKGLEWVSG ISGSGAGTYYADSVKGRFTISRDNSKNTLYLQMNSLRAEDTAVYYCARHA WWKGAGFFDHWGQGTLVTVSS |
| 3-H10 | 2113 | EVQLLESGGGLVQPGGSLRLSCAASGFTFRSHAMSWVRQAPGKGLEWVSSI SGGGASTYYADSVKGRFTISRDNSKNTLYLQMNSLRAEDTAVYYCARVKY LTTSSGWPRPYFDNWGQGTLVTVSS |
| 3-H11 | 2114 | EVQLLESGGGLVQPGGSLRLSCAASGFTITNYAMSWVRQAPGKGLEWVSG ISGSGASTYYADSVKGRFTISRDNSKNTLYLQMNSLRAEDTAVYYCARHT WWKGAGFFDHWGQGTLVTVSS |
| 3-H12 | 2115 | EVQLLESGGGLVQPGGSLRLSCAASGFTFRSHAMNWVRQAPGKGLEWVSA ISGSGGSTNYADSVKGRFTISRDNSKNTLYLQMNSLRAEDTAVYYCARGLK FLEWLPSAFDIWGQGTLVTVSS |
| 3-H13 | 2116 | EVQLLESGGGLVQPGGSLRLSCAASGFTFRSHAMSWVRQAPGKGLEWVSSI SGGGASTYYADSVKGRFTISRDNSKNTLYLQMNSLRAEDTAVYYCARVKY LTTSSGWPRPYFDNWGQGTLVTVSS |
| 3-H14 | 2117 | EVQLLESGGGLVQPGGSLRLSCAASGFTFRSYAMSWVRQAPGKGLEWVSSI SGGGASTYYADSVKGRFTISRDNSKNTLYLQMNSLRAEDTAVYYCARVKY LTTSSGWPRPYFDNWGQGTLVTVSS |

TABLE 26-continued

Reformatted ACE2 Variant Sequences

| Name | SEQ ID NO | Amino Acid Sequence |
|---|---|---|
| 3-H15 | 2118 | EVQLLESGGGLVQPGGSLRLSCAASGFTITNYAMSWVRQAPGKGLEWVSG ISGSGAGTYYADSVKGRFTISRDNSKNTLYLQMNSLRAEDTAVYYCARHT WWKGAGFFDHWGQGTLVTVSS |
| 3-L1 | 2119 | DIQMTQSPSSLSASVGDRVTITCRASQSIRKYLNWYQQKPGKAPKLLIYASS TLQRGVPSRFSGSGSGTDFTLTISSLQPEDFATYYCQQSLSTPFTFGQGTKVE IK |
| 3-L2 | 2120 | DIQMTQSPSSLSASVGDRVTITCRASQNIKTYLNWYQQKPGKAPKLLIYAAS KLQSGVPSRFSGSGSGTDFTLTISSLQPEDFATYYCQQSYSTSPTFGQGTKVE IK |
| 3-L3 | 2121 | DIQMTQSPSSLSASVGDRVTITCRASQTIYSYLNWYQQKPGKAPKLLIYATS TLQGGVPSRFSGSGSGTDFTLTISSLQPEDFATYYCQHRGTFGQGTKVEIK |
| 3-L4 | 2122 | DIQMTQSPSSLSASVGDRVTITCRASRSIRRYLNWYQQKPGKAPKLLIYASS SLQAGVPSRFSGSGSGTDFTLTISSLQPEDFATYYCQQSYSTLLTFGQGTKVE IK |
| 3-L5 | 2123 | DIQMTQSPSSLSASVGDRVTITCRASQSIGKYLNWYQQKPGKAPKLLIYASS SLQSGVPSRFSGSGSGTDFTLTISSLQPEDFATYYCQQSYSPPFTFGQGTKVEI K |
| 3-L6 | 2124 | DIQMTQSPSSLSASVGDRVTITCRASRSISRYLNWYQQKPGKAPKLLIYAAS SLQAGVPSRFSGSGSGTDFTLTISSLQPEDFATYYCQQSYSSLLTFGQGTKVE IK |
| 3-L7 | 2125 | DIQMTQSPSSLSASVGDRVTITCRASQSIGKYLNWYQQKPGKAPKLLIYASS TLQRGVPSRFSGSGSGTDFTLTISSLQPEDFATYYCQQSLSPPFTFGQGTKVE IK |
| 3-L8 | 2126 | DIQMTQSPSSLSASVGDRVTITCRASQSIGRYLNWYQQKPGKAPKLLIYASS SLQSGVPSRFSGSGSGTDFTLTISSLQPEDFATYYCQQSYSLPRTFGQGTKVE IK |
| 3-L9 | 2127 | DIQMTQSPSSLSASVGDRVTITCRASQSIGRYLNWYQQKPGKAPKLLIYAAS SLKSGVPSRFSGSGSGTDFTLTISSLQPEDFATYYCQQSYSLPRTFGQGTKVE IK |
| 3-L10 | 2128 | DIQMTQSPSSLSASVGDRVTITCRASQSIGKYLNWYQQKPGKAPKLLIYASS TLQRGVPSRFSGSGSGTDFTLTISSLQPEDFATYYCQQSLSTPFTFGQGTKVE IK |
| 3-L11 | 2129 | DIQMTQSPSSLSASVGDRVTITCRASQSIGRYLNWYQQKPGKAPKLLIYAAS SLKSGVPSRFSGSGSGTDFTLTISSLQPEDFATYYCQQSYSLPLTFGQGTKVE IK |
| 3-L12 | 2130 | DIQMTQSPSSLSASVGDRVTITCRTSQSINTYLNWYQQKPGKAPKLLIYGAS NVQSGVPSRFSGSGSGTDFTLTISSLQPEDFATYYCQQSYRIPRTFGQGTKVE IK |
| 3-L13 | 2131 | DIQMTQSPSSLSASVGDRVTITCRASQSIGKYLNWYQQKPGKAPKLLIYASS TLQRGVPSRFSGSGSGTDFTLTISSLQPEDFATYYCQQSFSPPFTFGQGTKVEI K |
| 3-L14 | 2132 | DIQMTQSPSSLSASVGDRVTITCRASQSIGKYLNWYQQKPGKAPKLLIYASS TLQRGVPSRFSGSGSGTDFTLTISSLQPEDFATYYCQQSFSTPFTFGQGTKVE IK |
| 3-L15 | 2133 | DIQMTQSPSSLSASVGDRVTITCRASQSIGRYLNWYQQKPGKAPKLLIYAAS SLKSGVPSRFSGSGSGTDFTLTISSLQPEDFATYYCQQSYSLPRTFGQGTKVE IK |
| 3-H16 | 2134 | EVQLLESGGGLVQPGGSLRLSCAASGFTFTNFAMSWVRQAPGKGLEWVSA ISGRGGGTYYADSVKGRFTISRDNSKNTLYLQMNSLRAEDTAVYYCARDA HGYYYDSSGYDDWGQGTLVTVSS |
| 3-H17 | 2135 | EVQLLESGGGLVQPGGSLRLSCAASGFTFRSYPMSWVRQAPGKGLEWVSTI SGSGGITYYADSVKGRFTISRDNSKNTLYLQMNSLRAEDTAVYYCAKGVY GSTVTTCHWGQGTLVTVSS |

TABLE 26-continued

Reformatted ACE2 Variant Sequences

| Name | SEQ ID NO | Amino Acid Sequence |
|---|---|---|
| 3-H18 | 2136 | EVQLLESGGGLVQPGGSLRLSCAASGFTLTSYAMSWVRQAPGKGLEWVSAISGSGVDTYYADSVKGRFTISRDNSKNTLYLQMNSLRAEDTAVYYCARPTNWGFDYWGQGTLVTVSS |
| 3-H19 | 2137 | EVQLLESGGGLVQPGGSLRLSCAASGFTFINYAMSWVRQAPGKGLEWVSTISTSGGNTYYADSVKGRFTISRDNSKNTLYLQMNSLRAEDTAVYYCARADSNWASSAYWGQGTLVTVSS |
| 3-H20 | 2138 | EVQLLESGGGLVQPGGSLRLSCAASGFPFSTYAMSWVRQAPGKGLEWVSGISVSGGFTYYADSVKGRFTISRDNSKNTLYLQMNSLRAEDTAVYYCARDPYSYGYYYYYGMDVWGQGTLVTVSS |
| 3-H21 | 2139 | EVQLLESGGGLVQPGGSLRLSCAASGFTFSTYAMGWVRQAPGKGLEWVSGISGGGVSTYYADSVKGRFTISRDNSKNTLYLQMNSLRAEDTAVYYCARARNWGPSDYWGQGTLVTVSS |
| 3-H22 | 2140 | EVQLLESGGGLVQPGGSLRLSCAASGFIFSDYAMTWVRQAPGKGLEWVSAISGSAFYADSVKGRFTISRDNSKNTLYLQMNSLRAEDTAVYYCARDATYSSSWYNWFDPWGQGTLVTVSS |
| 3-H23 | 2141 | EVQLLESGGGLVQPGGSLRLSCAASGFTFSDYAMTWVRQAPGKGLEWVSDISGSGGSTYYADSVKGRFTISRDNSKNTLYLQMNSLRAEDTAVYYCARGTVTSFDFWGQGTLVTVSS |
| 3-H24 | 2142 | EVQLLESGGGLVQPGGSLRLSCAASGFTFSIYAMGWVRQAPGKGLEWVSFISGSGGSTYYADSVKGRFTISRDNSKNTLYLQMNSLRAEDTAVYYCAKDYHSASWFSAAADYWGQGTLVTVSS |
| 3-H25 | 2143 | EVQLLESGGGLVQPGGSLRLSCAASGFTFASYAMTWVRQAPGKGLEWVSAISESGGSTYYADSVKGRFTISRDNSKNTLYLQMNSLRAEDTAVYYCAREGQEYSSGSSYFDYWGQGTLVTVSS |
| 3-H26 | 2144 | EVQLLESGGGLVQPGGSLRLSCAASGFTFSEYAMSWVRQAPGKGLEWVSAITGSGGSTYYGDSVKGRFTISRDNSKNTLYLQMNSLRAEDTAVYYCARGSQTPYCGGDCPETFDYWGQGTLVTVSS |
| 3-H27 | 2145 | EVQLLESGGGLVQPGGSLRLSCAASGFTFDDYAMSWVRQAPGKGLEWVSGISGGGTSTYYADSVKGRFTISRDNSKNTLYLQMNSLRAEDTAVYYCARDLYSSGWYGFDYWGQGTLVTVSS |
| 3-H28 | 2146 | EVQLLESGGGLVQPGGSLRLSCAASGFTFNNYAMNWVRQAPGKGLEWVSAISGSVGSTYYADSVKGRFTISRDNSKNTLYLQMNSLRAEDTAVYYCARDNYDFWSGYYTNWFDPWGQGTLVTVSS |
| 3-H29 | 2147 | EVQLLESGGGLVQPGGSLRLSCAASGFTFTNHAMSWVRQAPGKGLEWVSAISGSGSNIYYADSVKGRFTISRDNSKNTLYLQMNSLRAEDTAVYYCARDSLSVTMGRGVVTYYYYGMDFWGQGTLVTVSS |
| 3-L16 | 2148 | DIQMTQSPSSLSASVGDRVTITCRASQIIGSYLNWYQQKPGKAPKLLIYTTSNLQSGVPSRFSGSGSGTDFTLTISSLQPEDFATYYCQQSYITPWTFGQGTKVEIK |
| 3-L17 | 2149 | DIQMTQSPSSLSASVGDRVTITCRASQSISRYINWYQQKPGKAPKLLIYEASSLESGVPSRFSGSGSGTDFTLTISSLQPEDFATYYCQQSHITPLTFGQGTKVEIK |
| 3-L18 | 2150 | DIQMTQSPSSLSASVGDRVTITCRASQSIYTYLNWYQQKPGKAPKLLIYSASNLHSGVPSRFSGSGSGTDFTLTISSLQPEDFATYYCQQSDTTPWTFGQGTKVEIK |
| 3-L19 | 2151 | DIQMTQSPSSLSASVGDRVTITCRASQSIATYLNWYQQKPGKAPKLLIYGASSLEGGVPSRFSGSGSGTDFTLTISSLQPEDFATYYCQQTFSSPFTFGQGTKVEIK |
| 3-L20 | 2152 | DIQMTQSPSSLSASVGDRVTITCRASQNINTYLNWYQQKPGKAPKLLIYSASSLQSGVPSRFSGSGSGTDFTLTISSLQPEDFATYYCQQSSLTPWTFGQGTKVEIK |
| 3-L21 | 2153 | DIQMTQSPSSLSASVGDRVTITCRASQGIATYLNWYQQKPGKAPKLLIYYASNLQSGVPSRFSGSGSGTDFTLTISSLQPEDFATYYCQQSYSTRFTFGQGTKVEIK |

TABLE 26-continued

Reformatted ACE2 Variant Sequences

| Name | SEQ ID NO | Amino Acid Sequence |
|---|---|---|
| 3-L22 | 2154 | DIQMTQSPSSLSASVGDRVTITCRASERISNYLNWYQQKPGKAPKLLIYTAS NLESGVPSRFSGSGSGTDFTLTISSLQPEDFATYYCQQSYTPPRTFGQGTKVE IK |
| 3-L23 | 2155 | DIQMTQSPSSLSASVGDRVTITCRASQSISSSLNWYQQKPGKAPKLLIYAAS RLQDGVPSRFSGSGSGTDFTLTISSLQPEDFATYYCQQSYSTPRSFGQGTKV EIK |
| 3-L24 | 2156 | DIQMTQSPSSLSASVGDRVTITCRASQSISSHLNWYQQKPGKAPKLLIYRAS TLQSGVPSRFSGSGSGTDFTLTISSLQPEDFATYYCQQTYNTPQTFGQGTKV EIK |
| 3-L25 | 2157 | DIQMTQSPSSLSASVGDRVTITCRASQSISSYLIWYQQKPGKAPKLLIYAASR LHSGVPSRFSGSGSGTDFTLTISSLQPEDFATYYCQQGYNTPRTFGQGTKVEI K |
| 3-L26 | 2158 | DIQMTQSPSSLSASVGDRVTITCRASPSISTYLNWYQQKPGKAPKLLIYTASR LQTGVPSRFSGSGSGTDFTLTISSLQPEDFATYYCQQTYSTPSSFGQGTKVEI K |
| 3-L27 | 2159 | DIQMTQSPSSLSASVGDRVTITCRASQNIAKYLNWYQQKPGKAPKLLIYGA SGLQSGVPSRFSGSGSGTDFTLTISSLQPEDFATYYCQQSHSPPITFGQGTKV EIK |
| 3-L28 | 2160 | DIQMTQSPSSLSASVGDRVTITCRASQSIGTYLNWYQQKPGKAPKLLIYAAS NLHSGVPSRFSGSGSGTDFTLTISSLQPEDFATYYCQESYSAPYTFGQGTKV EIK |
| 3-L29 | 2161 | DIQMTQSPSSLSASVGDRVTITCRASQSISPYLNWYQQKPGKAPKLLIYKAS SLQSGVPSRFSGSGSGTDFTLTISSLQPEDFATYYCQQSSSTPYTFGQGTKVE IK |

TABLE 27

Reformatted ACE2 Variant Sequences

| Name | SEQ ID NO | Amino Acid Sequence |
|---|---|---|
| 4-51 | 2162 | EVQLVESGGGLVQPGGSLRLSCAASGPGTAIMGWFRQAPGKEREFVARIST SGGSTKYADSVKGRFTISADNSKNTAYLQMNSLKPEDTAVYYCARTTVTT PPLIWGQGTLVTVSS |
| 4-52 | 2163 | EVQLVESGGGLVQPGGSLRLSCAASGRSFSNSVMGWFRQAPGKEREFVAR ITWNGGSTYYADSVKGRFTISADNSKNTAYLQMNSLKPEDTAVYYCATTE NPNPRWGQGTLVTVSS |
| 4-53 | 2164 | EVQLVESGGGLVQPGGSLRLSCAASGRTFGDDTMGWFRQAPGKEREFVA AVSWSGSGVYYADSVKGRFTITADNSKNTAYLQMNSLKPENTAVYYCAT DPPLFWGQGTLVTVSS |
| 4-54 | 2165 | EVQLVESGGGLVQPGGSLRLSCAASGRTFSDARMGWFRQAPGKEREFVGA VSWSGGTTVYADSVKGRFTISADNSKNTAYLQMNSLKPEDTAVYYCATTE DPYPRWGQGTLVTVSS |
| 4-49 | 2166 | EVQLVESGGGLVQPGGSLRLSCAASGRTFGDYIMGWFRQAPGKERESVAA INWSAGYTAYADSVKGRFTISADNSKNTAYLQMNSLKPEDTAVYYCARAS PNTGWHFDHWGQGTLVTVSS |
| 4-55 | 2167 | EVQLVESGGGLVQPGGSLRLSCAASGSGLSINAMGWFRQAPGKERESVAAI SWSGGSTYTAYADSVKGRFTISADNSKNTAYLQMNSLKPEDTAVYYCAA YQAGWGDWGQGTLVTVSS |
| 4-39 | 2168 | EVQLVESGGGLVQPGGSLRLSCAASGRTFSNAAMGWFRQAPGKEREFVAR ILWTGASRNYADSVKGRFTISADNSKNTAYLQMNSLKPEDTAVYYCATTE NPNPRWGQGTLVTVSS |

TABLE 27-continued

Reformatted ACE2 Variant Sequences

| Name | SEQ ID NO | Amino Acid Sequence |
| --- | --- | --- |
| 4-56 | 2169 | EVQLVESGGGLVQPGGSLRLSCAASGFSLDYYGMGWFRQAPGKERESVA<br>AISWNGDFTAYADSVKGRFTISADNSKNTAYLQMNSLKPEDTAVYYCAKR<br>ANPTGAYFDYWGQGTLVTVSS |
| 4-33 | 2170 | EVQLVESGGGLVQPGGSLRLSCAASGFTFSRHDM TABLE 27-continued Reformatted ACE2 Variant Sequences

| Name | SEQ ID NO | Amino Acid Sequence |
|---|---|---|
| 4-47 | 2187 | EVQLVESGGGLVQPGGSLRLSCAASGFTFDDDYVMGWFRQAPGKEREFV AAVSGSGDDTYYADSVKGRFTISADNSKNTAYLQMNSLKPEDTAVYYCA ADRRGLASTRAADYDWGQGTLVTVSS |
| 4-65 | 2188 | EVQLVESGGGLVQPGGSLRLSCAASGRTFGDYIMGWFRQAPGKEREFVAA INWSAGYTAYADSVKGRFTISADNSKNTAYLQMNSLKPEDTAVYYCATEP PLSCWHFDLWGQGTLVTVSS |
| 4-18 | 2189 | EVQLVESGGGLVQPGGSLRLSCAASGRTFGDYIMGWFRQAPGKEREIVAAI NWSGGYTPYADSVKGRFTISADNSKNTAYLQMNSLKPEDTAVYYCATAPP NTGWHFDHWGQGTLVTVSS |
| 4-66 | 2190 | EVQLVESGGGLVQPGGSLRLSCAASGRTFGDDTMGWFRQAPGKEREIVAA INWSAGYTPYADSVKGRFTISADNSKNTAYLQMNSLKPEDTAVYYCATDP PLFCCHFDLWGQGTLVTVSS |
| 4-36 | 2191 | EVQLVESGGGLVQPGGSLRLSCAASGRTFSDDTMGWFRQAPGKEREFVAA ISWSGGTTRYADSVKGRFTISADNSKNTAYLQMNSLKPEDTAVYYCATDP PLFWGQGTLVTVSS |
| 4-67 | 2192 | EVQLVESGGGLVQPGGSLRLSCAASGRTFSDDTMGWFRQAPGKEREFVAA INWSGDSTYYADSVKGRFTISADNSKNTAYLQMNSLKPEDTAVYYCATDP PLFWGQGTLVTVSS |
| 4-16 | 2193 | EVQLVESGGGLVQPGGSLRLSCAASGRTFSDDTMGWFRQAPGKEREFVAA INWSGGTTRYADSVKGRFTISADNSKNTAYLQMNSLKPEDTAVYYCATDP PLFWGQGTLVTVSS |
| 4-11 | 2194 | EVQLVESGGGLVQPGGSLRLSCAASGRTFSDDAMGWFRQAPGKEREFVAA IHWSGSSTRYADSVKGRFTISADNSKNTAYLQMNSLKPEDTAVYYCATDPP LFWGQGTLVTVSS |
| 4-68 | 2195 | EVQLVESGGGLVQPGGSLRLSCAASGRTFSDDTMGWFRQAPGKERELVGT INWSGGSTYYADSVKGRFTISADNSKNTAYLQMNSLKPEDTAVYYCATDP PLFWGQGTLVTVSS |
| 4-34 | 2196 | EVQLVESGGGLVQPGGSLRLSCAASGRTFGDYIMGWFRQAPGKEREFVAA INWSGGYTPYADSVKGRFTISADNSKNTAYLQMNSLKPEDTAVYYCATDP PLFWGQGTLVTVSS |
| 4-28 | 2197 | EVQLVESGGGLVQPGGSLRLSCAASGRTFGDDTMGWFRQAPGKERELVA AINWNGGNTHYADSVKGRFTISADNSKNTAYLQMNSLKPEDTAVYYCAT DPPLFWGQGTLVTVSS |
| 4-69 | 2198 | EVQLVESGGGLVQPGGSLRLSCAASGRTFSDDAMGWFRQAPGKEREFVAA INWSGGTTRYADSVKGRFTISADNSKNTAYLQMNSLKPEDTAVYYCATDP PLFWGQGTLVTVSS |
| 4-7 | 2199 | EVQLVESGGGLVQPGGSLRLSCAASGRTFGDYIMGWFRQAPGKERESVAA INWSAGYTPYADSVKGRFTISADNSKNTAYLQMNSLKPEDTAVYYCATDP PLFWGHVDLWGQGTLVTVSS |
| 4-71 | 2200 | EVQLVESGGGLVQPGGSLRLSCAASGRTFSDDTMGWFRQAPGKEREWVA SINWSGGSTYYADSVKGRFTISADNSKNTAYLQMNSLKPEDTAVYYCATD PPLFWGQGTLVTVSS |
| 4-23 | 2201 | EVQLVESGGGLVQPGGSLRLSCAASGRTFSDDAMGWFRQAPGKEREFVAG ISWNGGSIYYADSVKGRFTISADNSKNTAYLQMNSLKPEDTAVYYCATDPP LFWGQGTLVTVSS |
| 4-9 | 2202 | EVQLVESGGGLVQPGGSLRLSCAASGFTFDDYEMGWFRQAPGKEREFVAA ISWRGGTTYYADSVKGRFTISADNSKNTAYLQMNSLKPEDTAVYYCAADR RGLASTRAGDYDWGQGTLVTVSS |
| 4-72 | 2203 | EVQLVESGGGLVQPGGSLRLSCAASGRTFGDDTMGWFRQAPGKEREFVA AINWSGGYTPYADSVKGRFTISADNSKNTAYLQMNSLKPEDTAVYYCATD PPLFWGHVDLWGQGTLVTVSS |
| 4-73 | 2204 | EVQLVESGGGLVQPGGSLRLSCAASGRTFSDDAMGWFRQAPGKEREFVAA INWSGGSTRYADSVKGRFTISADNSKNTAYLQMNSLKPEDTAVYYCATDP PLFWGQGTLVTVSS |

TABLE 27-continued

Reformatted ACE2 Variant Sequences

| Name | SEQ ID NO | Amino Acid Sequence |
| --- | --- | --- |
| 4-29 | 2205 | EVQLVESGGGLVQPGGSLRLSCAASGVTLDDYAMGWFRQAPGKEREFVA VINWSGGSTDYADSVKGRFTISADNSKNTAYLQMNSLKPEDTAVYYCARG GGWVPSSTSESLNWYFDRWGQGTLVTVSS |
| 4-41 | 2206 | EVQLVESGGGLVQPGGSLRLSCAASGRTFGDYIMGWFRQAPGKERESVAA INWSGGTTPYADSVKGRFTISADNSKNTAYLQMNSLKPEDTAVYYCATDP PLFCCHVDLWGQGTLVTVSS |
| 4-74 | 2207 | EVQLVESGGGLVQPGGSLRLSCAASGLTFSDDTMGWFRQAPGKEREFVAA VSWSGGNTYYADSVKGRFTISADNSKNTAYLQMNSLKPEDTAVYYCATD PPLFWGQGTLVTVSS |
| 4-75 | 2208 | EVQLVESGGGLVQPGGSLRLSCAASGRTFGDDTMGWFRQAPGKEREFVA AINWTGGYTPYADSVKGRFTISADNSKNTAYLQMNSLKPEDTAVYYCATD PPLFWGQGTLVTVSS |
| 4-31 | 2209 | EVQLVESGGGLVQPGGSLRLSCAASGRTFGDYIMGWFRQAPGKEREFVATI NWTAGYTYYADSVKGRFTISADNSKNTAYLQMNSLKPEDTAVYYCATDP PLFCWHFDHWGQGTLVTVSS |
| 4-32 | 2210 | EVQLVESGGGLVQPGGSLRLSCAASGRTFGDDTMGWFRQAPGKEREFVA AINWSGGNTDYADSVKGRFTISADNSKNTAYLQMNSLKPEDTAVYYCATD PPLFWGQGTLVTVSS |
| 4-15 | 2211 | EVQLVESGGGLVQPGGSLRLSCAASGRTFGDYTMGWFRQAPGKEREFVA AINWSGGNTYYADSVKGRFTISADNSKNTAYLQMNSLKPEDTAVYYCATD PPLFWGQGTLVTVSS |
| 4-14 | 2212 | EVQLVESGGGLVQPGGSLRLSCAASGRTFSDDTMGWFRQAPGKEREFVAG INWSGNGVYYADSVKGRFTISADNSKNTAYLQMNSLKPEDTAVYYCATDP PLFWGQGTLVTVSS |
| 4-76 | 2213 | EVQLVESGGGLVQPGGSLRLSCAASGRTFGDYAMGWFRQAPGKERELVA PINWSGGSTYYADSVKGRFTISADNSKNTAYLQMNSLKPEDTAVYYCATD PPLFWGQGTLVTVSS |
| 4-50 | 2214 | EVQLVESGGGLVQPGGSLRLSCAASGGTFSNSGMGWFRQAPGKERELVAV VNWSGRRTYYADSVKGRFTISADNSKNTAYLQMNSLKPEDTAVYYCAVP WMDYNRRDWGQGTLVTVSS |
| 4-17 | 2215 | EVQLVESGGGLVQPGGSLRLSCAASGQLANFASYAMGWFRQAPGKEREF VAAITRSGSSTVYADSVKGRFTISADNSKNTAYLQMNSLKPEDTAVYYCAT TMNPNPRWGQGTLVTVSS |
| 4-37 | 2216 | EVQLVESGGGLVQPGGSLRLSCAASGRTFSDDIMGWFRQAPGKEREFVAAI NWTGGSTYYADSVKGRFTISADNSKNTAYLQMNSLKPEDTAVYYCATDPP LFWGQGTLVTVSS |
| 4-44 | 2217 | EVQLVESGGGLVQPGGSLRLSCAASGRTFGDYIMGWFRQAPGKEREIVAAI NWSAGYTAYADSVKGRFTISADNSKNTAYLQMNSLKPEDTAVYYCATAR PNTGWHFDHWGQGTLVTVSS |
| 4-77 | 2218 | EVQLVESGGGLVQPGGSLRLSCAASGRTFSDDTMGWFRQAPGKEREWVG SINWSGGSTYYADSVKGRFTISADNSKNTAYLQMNSLKPEDTAVYYCATD PPLFWGQGTLVTVSS |
| 4-78 | 2219 | EVQLVESGGGLVQPGGSLRLSCAASGRTFSDDTMGWFRQAPGKEREFVAG MTWSGSSTFYADSVKGRFTISADNSKNTAYLQMNSLKPEDTAVYYCATDP PLFWGQGTLVTVSS |
| 4-79 | 2220 | EVQLVESGGGLVQPGGSLRLSCAASGRTFGDYIMGWFRQAPGKERECVAA INWSGDYTDYADSVKGRFTISADNSKNTAYLQMNSLKPEDTAVYYCATDP PLFWGQGTLVTVSS |
| 4-8 | 2221 | EVQLVESGGGLVQPGGSLRLSCAASGRTFGDYIMGWFRQAPGKEREFVGG INWSGGYTYYADSVKGRFTISADNSKNTAYLQMNSLKPEDTAVYYCATDP PLFWGQGTLVTVSS |
| 4-81 | 2222 | EVQLVESGGGLVQPGGSLRLSCAASGRTFSDDTMGWFRQAPGKEREFVAA VNWSGGSTYYADSVKGRFTISADNSKNTAYLQMNSLKPEDTAVYYCATD PPLFWGQGTLVTVSS |

TABLE 27-continued

Reformatted ACE2 Variant Sequences

| Name | SEQ ID NO | Amino Acid Sequence |
|---|---|---|
| 4-82 | 2223 | EVQLVESGGGLVQPGGSLRLSCAASGRTFGDYAMGWFRQAPGKEREFVA AINWSGGYTRYADSVKGRFTISADNSKNTAYLQMNSLKPEDTAVYYCATD PPLFWGQGTLVTVSS |
| 4-83 | 2224 | EVQLVESGGGLVQPGGSLRLSCAASGRTFGDDTMGWFRQAPGKEREFVA AINWSGGYTPYADSVKGRFTISADNSKNTAYLQMNSLKPEDTAVYYCATD PPLFWGQGTLVTVSS |
| 4-35 | 2225 | EVQLVESGGGLVQPGGSLRLSCAASGRTFGDYIMGWFRQAPGKERESVAA INWSAGYTAYADSVKGRFTISADNSKNTAYLQMNSLKPEDTAVYYCARAS PNTGWHFDRWGQGTLVTVSS |
| 4-45 | 2226 | EVQLVESGGGLVQPGGSLRLSCAASGRTFGDYIMGWFRQAPGKEREFVAA INWSGGYTHYADSVKGRFTISADNSKNTAYLQMNSLKPEDTAVYYCATDP PLFWGQGTLVTVSS |
| 4-84 | 2227 | EVQLVESGGGLVQPGGSLRLSCAASGRTFSDDTMGWFRQAPGKEREFVAA ITWSGGRTRYADSVKGRFTISADNSKNTAYLQMNSLKPEDTAVYYCATDR PLFWGQGTLVTVSS |
| 4-85 | 2228 | EVQLVESGGGLVQPGGSLRLSCAASGRTFGDYIMGWFRQAPGKERESVAA INWSGGYTAYADSVKGRFTISADNSKNTAYLQMNSLKPEDTAVYYCATAS PNTGWHFDHWGQGTLVTVSS |
| 4-86 | 2229 | EVQLVESGGGLVQPGGSLRLSCAASGRTFSDDTMGWFRQAPGKEREFVAA IHWSGSSTRYADSVKGRFTISADNSKNTAYLQMNSLKPEDTAVYYCATDPP LFWGQGTLVTVSS |
| 4-87 | 2230 | EVQLVESGGGLVQPGGSLRLSCAASGRTFSDYTMGWFRQAPGKEREWVA AINWSGGTTYYADSVKGRFTISADNSKNTAYLQMNSLKPEDTAVYYCATD PPLFWGQGTLVTVSS |
| 4-88 | 2231 | EVQLVESGGGLVQPGGSLRLSCAASGRTFGDDTMGWFRQAPGKEREFVA AINWSGDNTHYADSVKGRFTISADNSKNTAYLQMNSLKPEDTAVYYCATD PPLFWGQGTLVTVSS |
| 4-89 | 2232 | EVQLVESGGGLVQPGGSLRLSCAASGFAFGDNWIGWFRQAPGKEREWVA SISSGGTTAYADNVKGRFTIIADNSKNTAYLQMNSLKPEDTAVYYCAHRG GWLRPWGYWGQGTLVTVSS |
| 4-9 | 2233 | EVQLVESGGGLVQPGGSLRLSCAASGRTFSDDAMGWFRQAPGKEREFVGR INWSGGNTYYADSVKGRFTISADNSKNTAYLQMNSLKPEDTAVYYCATDP PLFWGQGTLVTVSS |
| 4-91 | 2234 | EVQLVESGGGLVQPGGSLRLSCAASGRTFSDDTMGWFRQAPGKEREFVGG ISWSGGNTYYADSVKGRFTISADNSKNTAYLQMNSLKPEDTAVYYCATDP PLFWGQGTLVTVSS |
| 4-92 | 2235 | EVQLVESGGGLVQPGGSLRLSCAASGRTFSDDTMGWFRQAPGKEREFVAA INWSGGSTYYADSVKGRFTISADNSKNTAYLQMNSLKPEDTAVYYCATDP PLFWGQGTLVTVSS |
| 4-46 | 2236 | EVQLVESGGGLVQPGGSLRLSCAASGRTFGDDTMGWFRQAPGKEREFVA AINWSGGYTYYADSVKGRFTISADNSKNTAYLQMNSLKPEDTAVYYCATD PPLFWGQGTLVTVSS |
| 4-20 | 2237 | EVQLVESGGGLVQPGGSLRLSCAASGRTFGDYIMGWFRQAPGKEREFVAA INWSADYTAYADSVKGRFTISADNSKNTAYLQMNSLKPEDTAVYYCATDP PLFCWHFDHWGQGTLVTVSS |
| 4-93 | 2238 | EVQLVESGGGLVQPGGSLRLSCAASGRTFSDDAMGWFRQAPGKEREFVAA INWSGSSTYYADSVKGRFTISADNSKNTAYLQMNSLKPEDTAVYYCATDP PLFWGQGTLVTVSS |
| 4-4 | 2239 | EVQLVESGGGLVQPGGSLRLSCAASGRTFGDYIMGWFRQAPGKEREMVA AINWIAGYTADADSVRRLFTITADNNKNTAHLMMNLLKPENTAVYYCAEP SPNTGWHFDHWGQGTLVTVSS |
| 4-2 | 2240 | EVQLVESGGGLVQPGGSLRLSCAASGRTFGDDTMGWFRQAPGKEREFVA AINWSGGNTPYADSVKGRFTISADNSKNTAYLQMNSLKPEDTAVYYCATD PPLFWGQGTLVTVSS |

TABLE 27-continued

Reformatted ACE2 Variant Sequences

| Name | SEQ ID NO | Amino Acid Sequence |
|---|---|---|
| 4-94 | 2241 | EVQLVESGGGLVQPGGSLRLSCAASGRTFSDDTMGWFRQAPGKEREFVAAINWSGDNTHYADSVKGRFTISADNSKNTAYLQMNSLKPEDTAVYYCATDPPLFWGQGTLVTVSS |
| 4-95 | 2242 | EVQLVESGGGLVQPGGSLRLSCAASGRTFGDYIMGWFRQAPGKEREIVAAINWSAGYTAYADSVKGRFTISADNSKNTAYLQMNSLKPEDTAVYYCATAPPLFCWHFDHWGQGTLVTVSS |
| 4-12 | 2243 | EVQLVESGGGLVQPGGSLRLSCAASGFTFGDYVMGWFRQAPGKEREIVAAINWNAGYTAYADSVRGLFTITADNSKNTAYLQMNSLKPEDTAVYYCAKASPNTGWHFDHWGQGTLVTVSS |
| 4-30 | 2244 | EVQLVESGGGLVQPGGSLRLSCAASGRTFGDYTMGWFRQAPGKEREFVAAINWTGGYTYYADSVKGRFTISADNSKNTAYLQMNSLKPEDTAVYYCATDPPLFWGQGTLVTVSS |
| 4-27 | 2245 | EVQLVESGGGLVQPGGSLRLSCAASGRTFGDYIMGWFRQAPGKEREIVAAINWSAGYTAYADSVKGLFTITADNSKNTAYLQMNILKPEDTAVYYCARATPNTGWHFDHWGQGTLVTVSS |
| 4-22 | 2246 | EVQLVESGGGLVQPGGSLRLSCAASGRTFGDYIMGWFRQAPGKEREFVAAINWSGDNTHYADSVKGRFTISADNSKNTAYLQMNSLKPEDTAVYYCATDPPLFWGQGTLVTVSS |
| 4-96 | 2247 | EVQLVESGGGLVQPGGSLRLSCAASGRTFGDYIMGWFRQAPGKEREIVAAINWSAGYTPYADSVKGRFTISADNSKNTAYLQMNSLKPEDTAVYYCATDPPLFCCHFDHWGQGTLVTVSS |
| 4-97 | 2248 | EVQLVESGGGLVQPGGSLRLSCAASGRTFGDYIMGWFRQAPGKERESVAAINWSAGYTAYADSVKGRFTISADNSKNTAYLQMNSLKPEDTAVYYCATAPPNTGWHFDHWGQGTLVTVSS |
| 4-98 | 2249 | EVQLVESGGGLVQPGGSLRLSCAASGFTWGDYTMGWFRQAPGKEREFVAAINWSGGNTYYADSVKGRFTISADNSKNTAYLQMNSLKPEDTAVYYCAADRRGLASTRAADYDWGQGTLVTVSS |
| 4-99 | 2250 | EVQLVESGGGLVQPGGSLRLSCAASGIPSTLRAMGWFRQAPGKEREFVAAVSSLGPFTRYADSVKGRFTISADNSKNTAYLQMNSLKPEDTAVYYCAAKPGWVARDPSQYNWGQGTLVTVSS |
| 4-100 | 2251 | EVQLVESGGGLVQPGGSLRLSCAASGFSFDDDYVMGWFRQAPGKEREFVAAINWSGGSTYYADSVKGRFTISADNSKNTAYLQMNSLKPEDTAVYYCAADRRGLASTRAADYDWGQGTLVTVSS |
| 4-101 | 2252 | EVQLVESGGGLVQPGGSLRLSCAASGRTFSNAAMGWFRQAPGKEREFVARILWTGASRSYADSVKGRFTISADNSKNTAYLQMNSLKPEDTAVYYCATTENPNPRWGQGTLVTVSS |
| 4-102 | 2253 | EVQLVESGGGLVQPGGSLRLSCAASGGTFGVYHMGWFRQAPGKEREGVAAINMSGDDSAYADSVKGRFTISADNSKNTAYLQMNSLKPEDTAVYYCAILVGPGQVEFDHWGQGTLVTVSS |
| 4-103 | 2254 | EVQLVESGGGLVQPGGSLRLSCAASGFTFSSYYMGWFRQAPGKEREFVARISGSTFYADSVKGRFTISADNSKNTAYLQMNSLKPEDTAVYYCAALPFVCPSGSYSDYGDEYDWGQGTLVTVSS |
| 4-104 | 2255 | EVQLVESGGGLVQPGGSLRLSCAASGRTFSGDFMGWFRQAPGKEREFVGRINWSGGNTYYADSVRGLFTITADNNKNTAYLMMNLLKPEDTAVYYCPTDPPLFWGLGTLVTWSS |
| 4-105 | 2256 | EVQLVESGGGLVQPGGSLRLSCAASGSTLRDYAMGWFRQAPGKERESVAAITWSGGSTAYADSVKGRFTISADNSKNTAYLQMNSLKPEDTAVYYCASLLAGDRYFDYWGQGTLVTVSS |
| 4-106 | 2257 | EVQLVESGGGLVQPGGSLRLSCAASGFTFDDYTMGWFRQAPGKEREFVAAITDNGGSKYYADSVKGRFTISADNSKNTAYLQMNSLKPEDTAVYYCAADRRGLASTRAADYDWGQGTLVTVSS |
| 4-107 | 2258 | EVQLVESGGGLVQPGGSLRLSCAASGGTFSSYGMGWFRQAPGKEREFVAAINWSGASTYYADSVKGRFTISADNSKNTAYLQMNSLKPEDTAVYYCARDWRDRTWGNSLDYWGQGTLVTVSS |

TABLE 27-continued

Reformatted ACE2 Variant Sequences

| Name | SEQ ID NO | Amino Acid Sequence |
|---|---|---|
| 4-108 | 2259 | EVQLVESGGGLVQPGGSLRLSCAASGFSFDDDYVMGWFRQAPGKEREFVA<br>AISWSEDNTYYADSVKGRFTISADNSKNTAYLQMNSLKPEDTAVYYCAAD<br>RRGLASTRAADYDWGQGTLVTVSS |
| 4-109 | 2260 | EVQLVESGGGLVQPGGSLRLSCAASGFSFDDDYVMGWFRQAPGKEREFVA<br>AVSGSGDDTYYADSVKGRFTISADNSKNTAYLQMNSLKPEDTAVYYCAA<br>DRRGLASTRAADYDWGQGTLVTVSS |
| 4-11 | 2261 | EVQLVESGGGLVQPGGSLRLSCAASGNIAAINVMGWFRQAPGKEREFVAA<br>ISASGRRTDYADSVKGRFTISADNSKNTAYLQMNSLKPEDTAVYYCARRV<br>YYYDSSGPPGVTFDIWGQGTLVTVSS |
| 4-111 | 2262 | EVQLVESGGGLVQPGGSLRLSCAASGIITSRYVMGWFRQAPGKEREGVAAI<br>STGGSTIYADSVKGRFTISADNSKNTAYLQMNSLKPEDTAVYYCARQDSSS<br>PYFDYWGQGTLVTVSS |
| 4-112 | 2263 | EVQLVESGGGLVQPGGSLRLSCAASGFSFDDDYVMGWFRQAPGKEREFVA<br>AISNSGLSTYYADSVKGRFTISADNSKNTAYLQMNSLKPEDTAVYYCAAD<br>RRGLASTRAADYDWGQGTLVTVSS |
| 4-113 | 2264 | EVQLVESGGGLVQPGGSLRLSCAASGSISSINVMGWFRQAPGKEREFVATM<br>RWSTGSTYYADSVKGRFTISADNSKNTAYLQMNSLKPEDTAVYYCAQRV<br>RGFFGPLRTTPSWYEWGQGTLVTVSS |
| 4-114 | 2265 | EVQLVESGGGLVQPGGSLRLSCAASGLTFILYRMGWFRQAPGKEREFVAAI<br>NNFGTTKYADSVKGRFTISADNSKNTAYLQMNSLKPEDTAVYYCARTHYD<br>FWSGYTSRTPNYFDYWGQGTLVTVSS |
| 4-115 | 2266 | EVQLVESGGGLVQPGGSLRLSCAASGGTFSVYHMGWFRQAPGKEREPVA<br>AISWSGGSTAYADSVKGRFTISADNSKNTAYLQMNSLKPEDTAVYYCAAV<br>NTWTSPSFDSWGQGTLVTVSS |
| 4-116 | 2267 | EVQLVESGGGLVQPGGSLRLSCAASGRAFSTYGMGWFRQAPGKEREFVAG<br>INWSGDTPYYADSVKGRFTISADNSKNTAYLQMNSLKPEDTAVYYCAREV<br>GPPPGYFDLWGQGTLVTVSS |
| 4-117 | 2268 | EVQLVESGGGLVQPGGSLRLSCAASGRTFSDIAMGWFRQAPGKEREFVASI<br>NWGGGNTYYADSVKGRFTISADNSKNTAYLQMNSLKPEDTAVYYCAAKG<br>IWDYLGRRDFGDWGQGTLVTVSS |
| 4-118 | 2269 | EVQLVESGGGLVQPGGSLRLSCAASGRTFSSARMGWFRQAPGKEREFVAA<br>ISWSGDNTHYADSVKGRFTISADNSKNTAYLQMNSLKPEDTAVYYCATTE<br>NPNPRWGQGTLVTVSS |
| 4-119 | 2270 | EVQLVESGGGLVQPGGSLRLSCAASGFAFSSYAMGWFRQAPGKEREWVA<br>TINGDDYTYYADSVKGRFTISADNSKNTAYLQMNSLKPEDTAVYYCVATP<br>GGYGLWGQGTLVTVSS |
| 4-12 | 2271 | EVQLVESGGGLVQPGGSLRLSCAASGITFRRHDMGWFRQAPGKEREFVAA<br>IRWSSSSTVYADSVKGRFTISADNSKNTAYLQMNSLKPEDTAVYYCAADR<br>GVYGGRWYRTSQYTWGQGTLVTVSS |
| 4-121 | 2272 | EVQLVESGGGLVQPGGSLRLSCAASGTAASFNPMGWFRQAPGKEREFVAA<br>ITSGGSTNYADSVKGRFTISADNSKNTAYLQMNSLKPEDTAVYYCAAIAYE<br>EGVYRWDWGQGTLVTVSS |
| 4-122 | 2273 | EVQLVESGGGLVQPGGSLRLSCAASGNINIINYMGWFRQAPGKEREGVAAI<br>HWNGDSTAYADSVKGRFTISADNSKNTAYLQMNSLKPEDTAVYYCASGPP<br>YSNYFAYWGQGTLVTVSS |
| 4-123 | 2274 | EVQLVESGGGLVQPGGSLRLSCAASGFTFDDYAMGWFRQAPGKERESVA<br>AISGSGGSTAYADSVKGRFTISADNSKNTAYLQMNSLKPEDTAVYYCAKI<br>MGSGRPYFDHWGQGTLVTVSS |
| 4-124 | 2275 | EVQLVESGGGLVQPGGSLRLSCAASGNIFTRNVMGWFRQAPGKEREFVAA<br>ITSSGSTNYADSVKGRFTISADNSKNTAYLQMNSLKPEDTAVYYCARPSSD<br>LQGGVDYWGQGTLVTVSS |
| 4-125 | 2276 | EVQLVESGGGLVQPGGSLRLSCAASGRTFSSIAMGWFRQAPGKEREFVASI<br>NWGGGNTIYADSVKGRFTISADNSKNTAYLQMNSLKPEDTAVYYCAAKGI<br>WDYLGRRDFGDWGQGTLVTVSS |

TABLE 27-continued

Reformatted ACE2 Variant Sequences

| Name | SEQ ID NO | Amino Acid Sequence |
|---|---|---|
| 4-126 | 2277 | EVQLVESGGGLVQPGGSLRLSCAASGIPSTLRAMGWFRQAPGKEREFVAA VSSLGPFTRYADSVKGRFTISADNSKNTAYLQMNSLKPEDTAVYYCAAKP GWVARDPSEYNWGQGTLVTVSS |
| 4-127 | 2278 | EVQLVESGGGLVQPGGSLRLSCAASGFTLDDSAMGWFRQAPGKEREWVA AITNGGSTYYADSVKGRFTISADNSKNTAYLQMNSLKPEDTAVYYCARFA RGSPYFDFWGQGTLVTVSS |
| 4-128 | 2279 | EVQLVESGGGLVQPGGSLRLSCAASGSISSFNAMGWFRQAPGKERESVAAI DWDGSTAYADSVKGRFTISADNSKNTAYLQMNSLKPEDTAVYYCARGGG YYGSGSFEYWGQGTLVTVSS |
| 4-129 | 2280 | EVQLVESGGGLVQPGGSLRLSCAASGNIFSDNIIGWFRQAPGKEREMVAYY TSGGSIDYADSVKGRFTISADNSKNTAYLQMNSLKPEDTAVYYCARGTAV GRPPPGGMDVWGQGTLVTVSS |
| 4-13 | 2281 | EVQLVESGGGLVQPGGSLRLSCAASGSISSIGAMGWFRQAPGKEREGVAAI SSSGSSTVYADSVKGRFTISADNSKNTAYLQMNSLKPEDTAVYYCARVPPG QAYFDSWGQGTLVTVSS |
| 4-131 | 2282 | EVQLVESGGGLVQPGGSLRLSCAASGFTFDDYGMGWFRQAPGKERELVAT ITWSGDSTYYADSVKGRFTISADNSKNTAYLQMNSLKPEDTAVYYCAKGG SWYYDSSGYYGRWGQGTLVTVSS |
| 4-132 | 2283 | EVQLVESGGGLVQPGGSLRLSCAASGRTFSNYTMGWFRQAPGKEREWVS AISWSTGSTYYADSVKGRFTISADNSKNTAYLQMNSLKPEDTAVYYCAAD RYGPPWYDWGQGTLVTVSS |
| 4-134 | 2284 | EVQLVESGGGLVQPGGSLRLSCAASGGTFSSVGMGWFRQAPGKERELVAV INWSGARTYYADSVKGRFTISADNSKNTAYLQMNSLKPEDTAVYYCAVP WMDYNRRDWGQGTLVTVSS |
| 4-135 | 2285 | EVQLVESGGGLVQPGGSLRLSCAASGRIFTNTAMGWFRQAPGKEREGVAA INWSGGSTAYADSVKGRFTISADNSKNTAYLQMNSLKPEDTAVYYCARTS GSYSFDYWGQGTLVTVSS |
| 4-136 | 2286 | EVQLVESGGGLVQPGGSLRLSCAASGEEFSDHWMGWFRQAPGKEREFVG AIHWSGGRTYYADSVKGRFTISADNSKNTAYLQMNSLKPEDTAVYYCAA DRRGLASTRAADYDWGQGTLVTVSS |
| 4-137 | 2287 | EVQLVESGGGLVQPGGSLRLSCAASGRTFSSIAMGWFRQAPGKEREFVAAI NWSGARTAYADSVKGRFTISADNSKNTAYLQMNSLKPEDTAVYYCAAKG IWDYLGRRDFGDWGQGTLVTVSS |
| 4-138 | 2288 | EVQLVESGGGLVQPGGSLRLSCAASGSTSSLRTMGWFRQAPGKEREGVAA ISSRDGSTIYADSVKGRFTISADNSKNTAYLQMNSLKPEDTAVYYCARDDS SSPYFDYWGQGTLVTVSS |
| 4-139 | 2289 | EVQLVESGGGLVQPGGSLRLSCAASGGGTFGSYAMGWFRQAPGKEREFV AAISIASGASGGTTNYADSVKGRFTISADNSKNTAYLQMNSLKPEDTAVYY CATTMNPNPRWGQGTLVTVSS |
| 4-14 | 2290 | EVQLVESGGGLVQPGGSLRLSCAASGRTFSNAAMGWFRQAPGKEREFVAR ITWNGGSTFYADSVKGRFTISADNSKNTAYLQMNSLKPEDTAVYYCATTE NPNPRWGQGTLVTVSS |
| 4-141 | 2291 | EVQLVESGGGLVQPGGSLRLSCAASGIILSDNAMGWFRQAPGKEREFVAAI SWLGESTYYADSVKGRFTISADNSKNTAYLQMNSLKPEDTAVYYCAADRR GLASTRAADYDWGQGTLVTVSS |
| 4-142 | 2292 | EVQLVESGGGLVQPGGSLRLSCAASGRTFGDYIMGWFRQAPGKERESVAA INWNGGYTAYADSVKGRFTISADNSKNTAYLQMNSLKPEDTAVYYCATTS PNTGWHYYRWGQGTLVTVSS |
| 4-143 | 2293 | EVQLVESGGGLVQPGGSLRLSCAASGFNFNWYPMGWFRQAPGKERESVA AISWTGVSTYTAYADSVKGRFTISADNSKNTAYLQMNSLKPEDTAVYYCA RWGPGPAGGSPGLVGFDYWGQGTLVTVSS |
| 4-144 | 2294 | EVQLVESGGGLVQPGGSLRLSCAASGSIRSVSVMGWFRQAPGKEREAVAA ISWSGVGTAYADSVKGRFTISADNSKNTAYLQMNSLKPEDTAVYYCAAYQ RGWGDWGQGTLVTVSS |

TABLE 27-continued

| Reformatted ACE2 Variant Sequences | | |
|---|---|---|
| Name | SEQ ID NO | Amino Acid Sequence |
| 4-145 | 2295 | EVQLVESGGGLVQPGGSLRLSCAASGMTFRLYAMGWFRQAPGKEREFVG AINWLSESTYYADSVKGRFTISADNSKNTAYLQMNSLKPEDTAVYYCAAK PGWVARDPSEYNWGQGTLVTVSS |
| 4-146 | 2296 | EVQLVESGGGLVQPGGSLRLSCAASGRTFSDDAMGWFRQAPGKEREFVAA INWSGGSTYYADSVKGRFTISADNSKNTAYLQMNSLKPEDTAVYYCATDP PLFWGQGTMVTVSS |
| 4-147 | 2297 | EVQLVESGGGLVQPGGSLRLSCAASGGTFSVYAMGWFRQAPGKEREGVA AISMSGDDAAYADSVKGRFTISADNSKNTAYLQMNSLKPEDTAVYYCAKI SKDDGGKPRGAFFDSWGQGTLVTVSS |
| 4-148 | 2298 | EVQLVESGGGLVQPGGSLRLSCAASGFALGYYAMGWFRQAPGKERESVA AISSRDGSTAYADSVKGRFTISADNSKNTAYLQMNSLKPEDTAVYYCARL ATGPQAYFHHWGQGTLVTVSS |
| 4-149 | 2299 | EVQLVESGGGLVQPGGSLRLSCAASGFNLDDYAMGWFRQAPGKERESVA AISWDGGATAYADSVKGRFTISADNSKNTAYLQMNSLKPEDTAVYYCAR VGRGTTAFDSWGQGTLVTVSS |
| 4-15 | 2300 | EVQLVESGGGLVQPGGSLRLSCAASGNTFSGGFMGWFRQAPGKEREFVAS IRSGARTYYADSVKGRFTISADNSKNTAYLQMNSLKPEDTAVYYCAQRVR GFFGPLRTTPSWYEWGQGTLVTVSS |
| 4-151 | 2301 | EVQLVESGGGLVQPGGSLRLSCAASGSIRSINIMGWFRQAPGKEREAVAAIS WSGGSTVYADSVKGRFTISADNSKNTAYLQMNSLKPEDTAVYYCASLLAG DRYFDYWGQGTLVTVSS |

TABLE 28

| SARS-CoV-2 Variant Variable Heavy Chain Sequences | | |
|---|---|---|
| 7-1 | 2302 | EVQLVESGGGLVQPGGSLRLSCAASGFTLGDYVMGWFRQAPGKEREFVA AIHSGGSTYADSVKGRFTISADNSKNTAYLQMNSLKPEDTAVYYCAAKEY GGTRRYDRAYNWGQGTLVTVSS |
| 7-2 | 2303 | EVQLVESGGGLVQPGGSLRLSCAASGGGTFGSYAMGWFRQAPGKERELV AAISSGGSTNYADSVKGRFTISADNSKNTAYLQMNSLKPEDTAVYYCARG DWRYGWGQGTLVTVSS |
| 7-3 | 2304 | EVQLVESGGGLVQPGGSLRLSCAASGRTYSISAMGWFRQAPGKEREFVAAI SMSGDDSAYADSVKGRFTISADNSKNTAYLQMNSLKPEDTAVYYCAAQL GYESGYSLTYDYDWGQGTLVTVSS |
| 7-4 | 2305 | EVQLVESGGGLVQPGGSLRLSCAASGGTFSTYPMGWFRQAPGKEREFVAA ITSDGSTLYADSVKGRFTISADNSKNTAYLQMNSLKPEDTAVYYCAATDY NKAYAREGRRYDWGQGTLVTVSS |
| 7-5 | 2306 | EVQLVESGGGLVQPGGSLRLSCAASGSIFRINAMGWFRQAPGKEREFVAAI HWSGSSTRYADSVKGRFTISADNSKNTAYLQMNSLKPEDTAVYYCAAQD RRRGDYYTFDYHWGQGTLVTVSS |
| 7-6 | 2307 | EVQLVESGGGLVQPGGSLRLSCAASGGTFNNYAMGWFRQAPGKERELVA AITSGGSTDYADSVKGRFTISADNSKNTAYLQMNSLKPEDTAVYYCARGD WRYGWGQGTLVTVSS |
| 7-7 | 2308 | EVQLVESGGGLVQPGGSLRLSCAASGTIVNINVMGWFRQAPGKEREFVAAI HWSGGLKAYADSVKGRFTISADNSKNTAYLQMNSLKPEDTAVYYCAMNR AGIYEWGQGTLVTVSS |
| 7-8 | 2309 | EVQLVESGGGLVQPGGSLRLSCAASGSTFSNYAMGWFRQAPGKERELVAA ITSGGSTSYADSVKGRFTISADNSKNTAYLQMNSLKPEDTAVYYCARGDW RYGWGQGTLVTVSS |
| 7-9 | 2310 | EVQLVESGGGLVQPGGSLRLSCAASGFSFDDYVMGWFRQAPGKEREFVAA ISRSGNLKSYADSVKGRFTISADNSKNTAYLQMNSLKPEDTAVYYCAAKE YGGTRRYDRAYNWGQGTLVTVSS |

TABLE 28-continued

SARS-CoV-2 Variant Variable Heavy Chain Sequences 7-10 2311 EVQLVESGGGLVQPGGSLRLSCAASGSAFRSTVMGWFRQAPGKEREFVAA
VIGSSGITDYADSVKGRFTISADNSKNTAYLQMNSLKPEDTAVYYCARGD
WRYGWGQGTLVTVSS 7-11 2312 EVQLVESGGGLVQPGGSLRLSCAASGRTFSDAGMGWFRQAPGKEREFVAA
ISRSGNLKAYADSVKGRFTISADNSKNTAYLQMNSLKPEDTAVYYCAVQV
NGTWAWGQGTLVTVSS 7-12 2313 EVQLVESGGGLVQPGGSLRLSCAASGFTLDYYAMGWFRQAPGKERELVA
AISWNGGSTSYADSVKGRFTISADNSKNTAYLQMNSLKPEDTAVYYCARG
DWRYGWGQGTLVTVSS 7-13 2314 EVQLVESGGGLVQPGGSLRLSCAASGGTFSTYVMGWFRQAPGKEREFVAA
ISWSGESTLYADSVKGRFTISADNSKNTAYLQMNSLKPEDTAVYYCAADL
MYGVDRRYDWGQGTLVTVSS 7-14 2315 EVQLVESGGGLVQPGGSLRLSCAASGISSSKRNMGWFRQAPGKEREFVAGI
SWTGGITYYADSVKGRFTISADNSKNTAYLQMNSLKPEDTAVYYCAIAGR
GRWGQGTLVTVSS 7-15 2316 EVQLVESGGGLVQPGGSLRLSCAASGRRFSAYGMGWFRQAPGKEREFVA
VISRSGTLTRYADSVKGRFTISADNSKNTAYLQMNSLKPEDTAVYYCASSG
PADARNGERWHWGQGTLVTVSS 7-16 2317 EVQLVESGGGLVQPGGSLRLSCAASGLTFSSFVMGWFRQAPGKEREFVAAI
SSNGGSTRYADSVKGRFTISADNSKNTAYLQMNSLKPEDTAVYYCAAKEY
GGTRRYDRAYNWGQGTLVTVSS 7-17 2318 EVQLVESGGGLVQPGGSLRLSCAASGTVFSISAMGWFRQAPGKEREFVAAI
SMSGDDTAYADSVKGRFTISADNSKNTAYLQMNSLKPEDTAVYYCAAQL
GYESGYSLTYDYDWGQGTLVTVSS 7-18 2319 EVQLVESGGGLVQPGGSLRLSCAASGSIFSPNVMGWFRQAPGKEREFVAAI
TNGGSTKYADSVKGRFTISADNSKNTAYLQMNSLKPEDTAVYYCAAQRW
RGGSYEWGQGTLVTVSS 7-19 2320 EVQLVESGGGLVQPGGSLRLSCAASGIPASIRVMGWFRQAPGKEREFVAAI
HWSGSSTRYADSVKGRFTISADNSKNTAYLQMNSLKPEDTAVYYCALSRA
IVPGDSEYDYRWGQGTLVTVSS 7-20 2321 EVQLVESGGGLVQPGGSLRLSCAASGRTFSMSAMGWFRQAPGKEREFVSA
ISWSGGSTLYADSVKGRFTISADNSKNTAYLQMNSLKPEDTAVYYCAAQL
GYESGYSLTYDYDWGQGTLVTVSS 7-21 2322 EVQLVESGGGLVQPGGSLRLSCAASGRTFSNYAMGWFRQAPGKERELVA
AITSGGSTDYADSVKGRFTISADNSKNTAYLQMNSLKPEDTAVYYCARGD
WRYGWGQGTLVTVSS 7-22 2323 EVQLVESGGGLVQPGGSLRLSCAASGRTFSSYAMGWFRQAPGKERELVAA
ISTGGSTYYADSVKGRFTISADNSKNTAYLQMNSLKPEDTAVYYCARGDW
RYGWGQGTLVTVSS 7-23 2324 EVQLVESGGGLVQPGGSLRLSCAASGRSFSSVGMGWFRQAPGKEREFVAV
ISRSGASTAYADSVKGRFTISADNSKNTAYLQMNSLKPEDTAVYYCASGP
ADARNGERWAWGQGTLVTVSS 7-24 2325 EVQLVESGGGLVQPGGSLRLSCAASGRAFRRYTMGWFRQAPGKERELIAV
INWSGDRRYYADSVKGRFTISADNSKNTAYLQMNSLKPEDTAVYYCAATL
AKGGGRWGQGTLVTVSS 7-25 2326 EVQLVESGGGLVQPGGSLRLSCAAMAWAGFARRRAKNAKWWRALPRGG
PTYADSVKGRFTISADNSKNTAYLQMNSLKPEDTAVYYCAAGGMWYGSS
LYVRFDLLEDGMDWGQGTLVTVSS 7-26 2327 EVQLVESGGGLVQPGGSLRLSCAASGSISSINGMGWFRQAPGKERELVALI
SRSGGTTYYADSVKGRFTISADNSKNTAYLQMNSLKPEDTAVYYCASAGP
ADARNGERWAWGQGTLVTVSS 7-27 2328 EVQLVESGGGLVQPGGSLRLSCAASGRTFSNNVMGWFRQAPGKERELVA
AAISGGSTYYADSVKGRFTISADNSKNTAYLQMNSLKPEDTAVYYCARGD
WRYGWGQGTLVTVSS 7-28 2329 EVQLVESGGGLVQPGGSLRLSCAASGRTFSISAMGWFRQAPGKEREFVAAI
SRSGTTMYADSVKGRFTISADNSKNTAYLQMNSLKPEDTAVYYCAAQLGY
ESGYSLTYDYDWGQGTLVTVSS TABLE 28-continued SARS-CoV-2 Variant Variable Heavy Chain Sequences 7-29  2330  EVQLVESGGGLVQPGGSLRLSCAASGGTFSYYDLAAMGWFRQAPGKEREF
             VAAISWSQYNTKYADSVKGRFTISADNSKNTAYLQMNSLKPEDTAVYYCA
             ARVVVRTAHGFEDNWGQGTLVTVSS 7-30  2331  EVQLVESGGGLVQPGGSLRLSCAASGRTFNNYGMWFRQAPGKEREFVA
             VISRSGSLKAYADSVKGRFTISADNSKNTAYLQMNSLKPEDTAVYYCASDP
             TYGSGRWTWGQGTLVTVSS 7-31  2332  EVQLVESGGGLVQPGGSLRLNCAASGFTLDDYVMGWFRQTPGKEREFVA
             AISSSGALTSYADSVKGRFTISADNSKNTAYLQMNSLKPEDAAVYYCAAKE
             YGGTRRYDRAYNWGQGTLVTVSS 7-32  2333  EVQLVESGGGLVQPGGSLRLSCAASGRTFNAMGWFRQAPGKEREFVAAIR
             WSGDMSVYADSVKGRFTISADNSKNTAYLQMNSLKPEDTAVYYCAAQDR
             RRGDYYTFDYHWGQGTLVTVSS 7-33  2334  EVQLVESGGGLVQPGGSLRLSCAASGLTFSTYAMGWFRQAPGKEREFVAA
             ITSGGSTDYADSVKGRFTISADNSKNTAYLQMNSLKPEDTAVYYCARGDW
             RYGWGQGTLVTVSS 7-34  2335  EVQLVESGGGLVQPGGSLRLSCAASGSIFTINAMGWFRQAPGKEREGVAAI
             GSDGSTSYADSVKGRFTISADNSKNTAYLQMNSLKPEDTAVYYCAVVRW
             GADWGQGTLVTVSS 7-35  2336  EVQLVESGGGLVQPGGSLRLSCAASGLTFSSYAMGWFRQAPGKERELVAA
             ITSSSGSTPAYADSVKGRFTISADNSKNTAYLQMNSLKPEDTAVYYCARGD
             WRYGWGQGTLVTVSS 7-36  2337  EVQLVESGGGLVQPGGSLRLSCAASGIPFSTRTMGWFRQAPGKEREFVAAI
             SWSQYNTKYADSVKGRFTISADNSKNTAYLQMNSLKPEDTAVYYCAARH
             WGMFSRSENDYNWGQGTLVTVSS 7-37  2338  EVQLVESGGGLVQPGGSLRLSCAASGRSRFSTYVMGWFRQAPGKEREFVA
             AISWSQYNTKYADSVKGRFTISADNSKNTAYLQMNSLKPEDTAVYYCAAG
             NGGRNYGHSRARYDWGQGTLVTVSS 7-38  2339  EVQLVESGGGLVQPGGSLRLSCAASGLTLSSYGMGWFRQAPGKEREYVAV
             ISRSGSLKAYADSVKGRFTISADNSKNTAYLQMNSLKPEDTAVYYCATRA
             DAEGWWDWGQGTLVTVSS 7-39  2340  EVQLVESGGGLVQPGGSLRLSCAASGSIFRVNVMGWFRQAPGKEREFVAA
             INNFGTTKYADSVKGRFTISADNSKNTAYLQMNSLKPEDTAVYYCAADLP
             SRWGQGTLVTVSS 7-40  2341  EVQLVESGGGLVQPGGSLRLSCAASGRTFRNYAMGWFRQAPGKERELVA
             AISSGGSTDYADSVKGRFTISADNSKNTAYLQMNSLKPEDTAVYYCARGD
             WRYGWGQGTLVTVSS 7-41  2342  EVQLVESGGGLVQPGGSLRLSCAASGRTFSSFAMGWFRQAPGKERELVAA
             ISSGGSTNYADSVKGRFTISADNSKNTAYLQMNSLKPEDTAVYYCARGDW
             RYGWGQGTLVTVSS 7-42  2343  EVQLVESGGGLVQPGGSLRLSCAASGTTFRINAMGWFRQAPGKEREFVAA
             MNWSGGSTKYADSVKGRFTISADNSKNTAYLQMNSLKPEDTAVYYCAAQ
             DRRRGDYYTFDYHWGQGTLVTVSS 7-43  2344  EVQLVESGGGLVQPGGSLRLSCAASGFTLGDYVMGWFRQAPGKEREFVA
             AIHSGGSTLYADSVKGRFTISADNSKNTAYLQMNSLKPEDTAVYYCAAKE
             YGGTRRYDRTYNWGQGTLVTVSS 7-44  2345  EVQLVESGGGLVQPGGSLRLSCAASGFTFSRSAMGWFRQAPGKERELVAG
             ILSSGATVYADSVKGRFTISADNSKNTAYLQMNSLKPEDTAVYYCAKAPR
             DWGQGTLVTVSS 7-45  2346  EVQLVESGGGLVQPGGSLRLSCAASGRTFNNYAMGWFRQAPGKERELVA
             AITSGGSTDYADSVKGRFTISADNSKNTAYLQMNSLKPEDTAVYYCARGD
             WRYGWGQGTLVTVSS 7-46  2347  EVQLVESGGGLVQPGGSLRLSCAASGTFRSYPMGWFRQAPGKEREFVAAI
             NNFGTTKYADSVKGRFTISADNSKNTAYLQMNSLKPEDTAVYYCAAKGI
             GVYGWGQGTLVTVSS 7-47  2348  EVQLVESGGGLVQPGGSLRLSCAASGNIFTRNVMGWFRQAPGKEREFVAA
             IHWNGDSTKYADSVKGRFTISADNSKNTAYLQMNSLKPEDTAVYYCAAGS
             NIGGSRWRYDWGQGTLVTVSS TABLE 28-continued

| SARS-CoV-2 Variant Variable Heavy Chain Sequences | | |
|---|---|---|
| 7-48 | 2349 | EVQLVESGGGLVQPGGSLRLSCAASGRTISRYTMGWFRQAPGKERELVAAI KWSGASTVYADSVKGRFTISADNSKNTAYLQMNSLKPEDTAVYYCAAKGI WDYLGRRDFGDWGQGTLVTVSS |
| 7-49 | 2350 | EVQLVESGGGLVQPGGSLRLSCAASGFRFSSYGMGWFRQAPGKEREFVAII TSGGLTVYADSVKGRFTISADNSKNTAYLQMNSLKPEDTAVYYCAARKTF YFGTSSYPNDYAWGQGTLVTVSS |
| 7-50 | 2351 | EVQLVESGGGLVQPGGSLRLSCAASGRTFDNHAMGWFRQAPGKEREGVA AIGSDGSTSYADSVKGRFTISADNSKNTAYLQMNSLKPEDTAVYYCAVVR WGVDWGQGTLVTVSS |
| 7-51 | 2352 | EVQLVESGGGLVQPGGSLRLSCAASGFTFSSHAMGWFRQAPGKEREFVAG ISWSGESTLTRYADSVKGRFTISADNSKNTAYLQMNSLKPEDTAVYYCAD VNGDWGQGTLVTVSS |
| 7-52 | 2353 | EVQLVESGGGLVQPGGSLRLSCAASGMTFRLYAMGWFRQAPGKEREFVA AISWSQYNTKYADSVKGRFTISADNSKNTAYLQMNSLKPEDTAVYYCAAQ LGYESGYSLTYDYDWGQGTLVTVSS |
| 7-53 | 2354 | EVQLVESGGGLVQPGGSLRLSCAASGGTFRKLAMGWFRQAPGKEREFVA VISWTGGSSYYADSVKGRFTISADNSKNTAYLQMNSLKPEDTAVYYCARL TSFATWGQGTLVTVSS |
| 7-54 | 2355 | EVQLVESGGGLVQPGGSLRLSCAASGRTFSANGMGWFRQAPGKEREFVAA ISASGTLRAYADSVKGRFTISADNSKNTAYLQMNSLKPEDTAVYYCAARSP MSPTWDWGQGTLVTVSS |
| 7-55 | 2356 | EVQLVESGGGLVQPGGSLRLSCAASGSAFRSTVMGWFRQAPGKEREFVAA ISWTGESTLYADSVKGRFTISADNSKNTAYLQMNSLKPEDTAVYYCATGP YRSYFARSYLWGQGTLVTVSS |
| 7-56 | 2357 | EVQLVESGGGLVQPGGSLRLSCAASGGTFDYSGMGWFRQAPGKEREFVA VVSQSGRTTYYADSVKGLFTITADNSKNTAYLQMNLLKPEDTAVYYCPTA TRPGEWDGGQGTLVTVSR |
| 7-57 | 2358 | EVQLVESGGGLVQPGGSLRLSCAASGVFGPIRAMGWFRQAPGKERELVAL MGNDGSTYADSVKGRFTISADNSKNTAYLQMNSLKPEDTAVYYCAAIGW RWGQGTLVTVSS |
| 7-58 | 2359 | EVQLVESGGGLVQPGGSLRLSCAASGFNFNWYPMGWFRQAPGKEREFVA AIRWSGGITYYADSVKGRFTISADNSKNTAYLQMNSLKPEDTAVYYCATG PYRSYFARSYLWGQGTLVTVSS |
| 7-59 | 2360 | EVQLVESGGGLVQPGGSLRLSCAASGMTFHRYVMGWFRQAPGKERELVA SITTGGTPNYADSVKGRFTIITDNNKNTAYLLMINLQPED- TAVYYCCKVPYI WGQGTLGTVGT |
| 7-60 | 2361 | EVQLVESGGGLVQPGGSLRLSCAASGISTMGWFRQAPGKEREFVAAINNFG TTKYADSVKGRFTISADNSKNTAYLQMNSLKPEDTAVYYCAAASQSGSGY DWGQGTLVTVSS |
| 7-61 | 2362 | EVQLVESGGGLVQPGGSLRLSCAASGRAFNTRAMGWFRQAPGKERELVA LMGNDGSTYADSVKGRFTISADNSKNTAYLQMNSLKPEDTAVYYCAAIG WRWGQGTLVTVSS |
| 7-62 | 2363 | EVQLVESGGGLVQPGGSLRLSCAASGLTDRRYTMGWFRQAPGKEREFVA AINSGGSTLYADSVKGRFTISADNSKNTAYLQMNSLKPEDTAVYYCAAGN GGRTYGHSRARYEWGQGTLVTVSS |
| 7-63 | 2364 | EVQLVESGGGLVQPGGSLRLSCAASGRTFNVMGWFRQAPGKERELVALM GNDGSTYADSVKGRFTISADNSKNTAYLQMNSLKPEDTAVYYCAAVRWG VDWGQGTLVTVSS |
| 7-64 | 2365 | EVQLVESGGGLVQPGGSLRLSCAASGRAFNTRAMGWFRQAPGKERELVA LMGNDGSTNYADSVKGRFTISADNSKNTAYLQMNSLKPEDTAVYYCAAIG WRWGQGTLVTVSS |
| 7-65 | 2366 | EVQVVESGGGVVHPGGSVRMRCAASGVTVDYSGMGWFGQAPGKEREFV AVVSQSARTTYYADSVKGRFTISADNSKNTEYLQMNSMKPEDTAVYYCAT ATRPGEWDWGQGTLVTVSS |
| 7-66 | 2367 | EVQLVESGGGLVQPGGSLRLSCAASGRTPRLGAMGWFRQAPGKEREFVAA ISRSGGLTSYADSVKGRFTISADNSKNTAYLQMNSLKPEDTAVYYCAAQLV GSNIGGSRWRYDWGQGTLVTVSS |

TABLE 28-continued

SARS-CoV-2 Variant Variable Heavy Chain Sequences

| | | |
|---|---|---|
| 7-67 | 2368 | EVQLVESGGGLVQPGGSLRLSCAASGLTFRNYAMGWFRQAPGKEREFVAAITSGGSTLYADSVKGRFTISADNSKNTAYLQMNSLKPEDTAVYYCARGDWRYGWGHGTLVTESS |
| 8-1 | 2369 | EVQLVESGGGLVQPGGSLRLSCAASGGRTFSDLAMGWFRQAPGKEREFVALITRSGGTTFYADSVKGRF

TABLE 29-continued

Membrane Protein CDR Sequences

| Variant | SEQ ID NO | CDRH1 | SEQ ID NO | CDRH2 | SEQ ID NO | CDRH3 |
|---|---|---|---|---|---|---|
| 9-6 | 2386 | RTFSRFAMG | 2458 | AAIRWSGGRTVYA | 2530 | CAIEPGTIRNWRNRVPFARGNFGW |
| 9-7 | 2387 | LGIAFSRRTAMG | 2459 | AAISWRGGNTYYA | 2531 | CAARRWIPPGPIW |
| 9-8 | 2388 | RTFRRYPMG | 2460 | AAISRSGGSTYYA | 2532 | CAAKRLRSFASGGSYDW |
| 9-9 | 2389 | GTLRGYGMG | 2461 | ASISRSGGSTYYA | 2533 | CAARRVTLFTSRADYDW |
| 9-10 | 2390 | RMFSSRSMG | 2462 | ALINRSGGSQFYA | 2534 | CAARRWIPPGPIW |
| 9-11 | 2391 | RTFGRRAMG | 2463 | AGISRGGGTNYA | 2535 | CAAKGIWDYLGRRDFGDW |
| 10-1 | 2392 | LSSPPFDDFPMG | 2464 | SSIYSDDGDSMYA | 2536 | CARQTFDFWSASLGGNFWYFDLW |
| 10-2 | 2393 | GTFSSYSMG | 2465 | SAISWIIGSGGTTNYA | 2537 | CTAGAGDSW |
| 10-3 | 2394 | SIFSTRTMG | 2466 | ASITKFGSTNYA | 2538 | CTRGGGRFFDWLYLRW |
| 10-4 | 2395 | RTLWRSNMG | 2467 | ASISSFGSTKYA | 2539 | CARGHGRYFDWLLFARPPDYW |
| 10-5 | 2396 | RSLGIYRMG | 2468 | AAITSGGRKNYA | 2540 | CAKRTIFGVGRWLDPW |
| 10-6 | 2397 | TTLTFRIMG | 2469 | PAISSTGLASYT | 2541 | CSKDRAPNCFACCPNGFDVW |
| 10-7 | 2398 | SRFSGRFNILNMG | 2470 | ARIGYSGQSISYA | 2542 | CARGRFLGGTEW |
| 10-8 | 2399 | TLFKINAMG | 2471 | AQINRHGVTYYA | 2543 | CARGRTIFFGGGRYFDYW |
| 10-9 | 2400 | IPFRSRTMG | 2472 | AGITGSGRSQYYA | 2544 | CARGARIFGSVAPWRGGNYYGMDVW |
| 10-10 | 2401 | FTFSSFRMG | 2473 | AGISRGGSTNYA | 2545 | CARASGLWFRRPHVW |
| 10-11 | 2402 | RNFRRNSMG | 2474 | AGISWSGARTHYA | 2546 | CARVSRRPRSPPGYYYGMDVW |
| 10-12 | 2403 | RNLRMYRMG | 2475 | ATIRWSDGSTYYA | 2547 | CTRARLRYFDWLFPTNFDYW |
| 10-13 | 2404 | GLTFSSNTMG | 2476 | ASISSSGRTSYA | 2548 | CARRVRRLWFRSYFDLW |
| 10-14 | 2405 | FTLAYYAMG | 2477 | AAISWSGRNINYA | 2549 | CARERARWFGKFSVSW |
| 10-15 | 2406 | RTFSSFPMG | 2478 | AAISWSGSTSYA | 2550 | SACGRLGFGAW |
| 10-16 | 2407 | ISSSKRNMG | 2479 | ATWTSRGITTYA | 2551 | CARGGPPRLWGSYRRKYFDYW |
| 10-17 | 2408 | RTFSIYAMG | 2480 | ARITRGGITKYA | 2552 | CARGLGWLLGYYW |
| 10-18 | 2409 | RMYNSYSMG | 2481 | ARISPGGTFYA | 2553 | CTTSARSGWFWRYFDSW |
| 10-19 | 2410 | RTFRSYGMG | 2482 | ASISRSGTTMYA | 2554 | CARRGLLQWFGAPNSWFDPW |

TABLE 29-continued

Membrane Protein CDR Sequences

| Variant | SEQ ID NO | CDRH1 | SEQ ID NO | CDRH2 | SEQ ID NO | CDRH3 |
|---|---|---|---|---|---|---|
| 10-20 | 2411 | RTIRTMG | 2483 | ATINSRGITNYA | 2555 | CTTERDGLLWFRELFRPSW |
| 10-21 | 2412 | RSFSFNAMG | 2484 | ARISRFGRTNYA | 2556 | CAKVHSYVWGGHSDYW |
| 10-22 | 2413 | RTYYAMG | 2485 | GAIDWSGRRITYA | 2557 | CARVRFSRLGGVIGRPIDSW |
| 10-23 | 2414 | RAFRRYTMG | 2486 | ASITKFGSTNYA | 2558 | CAKDRGVLWFGELWYW |
| 10-24 | 2415 | RTFSNYRMG | 2487 | ASINRGGSTKYA | 2559 | CASGKGGSATIFHLSRRPLYFDYW |
| 10-25 | 2416 | ITFSPYAMG | 2488 | ATINWSGGYTVYA | 2560 | CAKRKNRGPLWFGGGGWGYW |
| 10-26 | 2417 | RTFSGFTMSSTWMG | 2489 | AGIITNGSTNYA | 2561 | CARRVAYSSFWSGLRKHMDVW |
| 10-27 | 2418 | RTFRRYSMG | 2490 | ASITPGGNTNYA | 2562 | CASRRRWLTPYIFW |
| 10-28 | 2419 | SIFSIGMG | 2491 | ARIWWRSGATYYA | 2563 | CAAISIFGRLKW |
| 10-29 | 2420 | RTFTSYRMG | 2492 | AEISSSGGYTYYA | 2564 | CARVGPLRFLAQRPRLRPDYW |
| 10-30 | 2421 | RTFSSFRFRAMG | 2493 | ALIFSGGSTYYA | 2565 | CAREWGRWLQRGSYW |
| 10-31 | 2422 | RTFGSYGMG | 2494 | ATISIGGRTYYA | 2566 | CARGSGSGFMWYHGNNNYDRWRYW |
| 10-32 | 2423 | RTFRSYPMG | 2495 | ASINRGGSTNYA | 2567 | CARGRYDFWSGYYRWFDPW |
| 10-33 | 2424 | RTFSRSDMG | 2496 | AAISWSGGSTSYA | 2568 | CATVPPPRRFLEWLPRRLTYIW |
| 10-34 | 2425 | RTFRRYTMG | 2497 | ASMRGSRSYYA | 2569 | CARMSGFPPLDYW |
| 10-35 | 2426 | SIFRLSTMG | 2498 | ASISSFGSTYYA | 2570 | CARTRGIFLWFGESFDYW |
| 10-36 | 2427 | IAFRIRTMG | 2499 | ASITSGGSTNYA | 2571 | CARGGPRFGGFRGYFDPW |
| 10-37 | 2428 | FTFTSYRMG | 2500 | AGISRFFGTAYYA | 2572 | CARVTRWFGGLDVW |
| 10-38 | 2429 | RTFSRYVMG | 2501 | ASISRFGRTNYA | 2573 | CARHHGLGILWWGTMDVW |
| 10-39 | 2430 | RTFSMG | 2502 | ASISRFGRTNYA | 2574 | CAKRSTWLPQHFDSW |
| 10-40 | 2431 | RTFSTYTMG | 2503 | ARIWRSGGNTYYA | 2575 | CARGVRGVFRAYFDHW |
| 10-41 | 2432 | RNLRMYRMG | 2504 | ALISRVGVTSYA | 2576 | CARGTSFFNFWSGSLGRVGFDSW |
| 10-42 | 2433 | ITIRTHAMG | 2505 | ATISRSGGNTYYA | 2577 | CTTAGVLRYFDWFRRPYW |
| 10-43 | 2434 | RTFRRYHMG | 2506 | AAITSGGRTNYA | 2578 | CTTDGLRYFDWFPWASAFDIW |

TABLE 29-continued

Membrane Protein CDR Sequences

| Variant | SEQ ID NO | CDRH1 | SEQ ID NO | CDRH2 | SEQ ID NO | CDRH3 |
|---|---|---|---|---|---|---|
| 10-44 | 2435 | RTFRRYTMG | 2507 | AVISWSGGSTKYA | 2579 | CARKGRWSGMNVW |
| 10-45 | 2436 | RTFSWYPMG | 2508 | ASISWGGARTYYA | 2580 | CARSTGPRGSGRYAHWFDSW |
| 10-46 | 2437 | RTFTSYRMG | 2509 | AAITWNSGRTRYA | 2581 | CSPSSWPFYFGAW |
| 10-47 | 2438 | RPLRRYVMG | 2510 | AAITNGGSTKYA | 2582 | CARGTPWRLLWFGTLGPPPAFDYW |
| 10-48 | 2439 | RTFRRYAMG | 2511 | AAINRSGSTEYA | 2583 | CARQHQDFWTGYYTVW |
| 10-49 | 2440 | RTFRRYTMG | 2512 | ASISRSGTTYYA | 2584 | CAKEGWRWLQLRGGFDYW |
| 10-50 | 2441 | RTLSTYNMG | 2513 | ASISRFGRTNYA | 2585 | CARRGKLSAAMHWFDPW |
| 10-51 | 2442 | RFFSTRVMG | 2514 | ARIWPGGSTYYA | 2586 | CARDRGIFGVSRW |
| 10-52 | 2443 | RFFSICSMG | 2515 | AGINWRSGGSTYYA | 2587 | CARGSGWWEYW |
| 10-53 | 2444 | RMFSSRSNMG | 2516 | ASISSGGTTAYA | 2588 | CARGFGRRFLEWLPRFDYW |
| 10-54 | 2445 | RTFSSARMG | 2517 | AGINMISSTKYA | 2589 | CAHFRRFLPRGYVDYW |
| 10-55 | 2446 | RTFRRYTMG | 2518 | ARIAGGSTYYA | 2590 | CARQQYYDFWSGYFRSGYFDLW |
| 10-56 | 2447 | HTFRNYGMG | 2519 | AAITSSGSTNYA | 2591 | CATVPPPRRFLEWLPRRLTYTW |
| 10-57 | 2448 | RTFSRYAMG | 2520 | ASITKFGSTNYA | 2592 | CAKERESRFLKWRKTDW |
| 10-58 | 2449 | RNLRMYRMG | 2521 | ASISRFGRTNYA | 2593 | CARHDSIGLFRHGMDVW |
| 10-59 | 2450 | RTFRRYAMG | 2522 | ARISSGGSTSYA | 2594 | CARDRGFGFWSGLRGYFDLW |
| 10-60 | 2451 | IPASMYLG | 2523 | AAITSGGRTSYA | 2595 | CAKRKKRGPLWFGGGGWGYW |
| 10-61 | 2452 | IPFRSRTFSAYAMG | 2524 | AQITRGGSTNYA | 2596 | CARRHWFGFDYW |

TABLE 30

Membrane Protein VH Sequences

| Variant | SEQ ID NO | VH |
|---|---|---|
| 9-1 | 2597 | EVQLVESGGGLVQPGGSLRLSCAASGRTFSRLAMGWFRQAPGKEREFVAAISRSGRSTSYADSVKGRFTISADNSKNTAYLQMNSLKPEDTAVYYCAARRSQILFTSRTDYEWGQGTLVTVSS |
| 9-2 | 2598 | EVQLVESGGGLVQPGGSLRLSCAASGSFSIAAMGWFRQAPGKEREFVATINYSGGGTYYADSVKGRFTISADNSKNTAYLQMNSLKPEDTAVYYCAAVNTFDESAYAAFACYDVVWGQGTLVTVSS |

TABLE 30-continued

Membrane Protein VH Sequences

| Variant | SEQ ID NO | VH |
|---|---|---|
| 9-3 | 2599 | EVQLVESGGGLVQPGGSLRLSCAASGRTFSRYAMGWFRQAPGKEREFVAA<br>ISRSGKSTYYADSVKGRFTISADNSKNTAYLQMNSLKPEDTAVYYCAASSV<br>FSDLRYRKNPKWGQGTLVTVSS |
| 9-4 | 2600 | EVQLVESGGGLVQPGGSLRLSCAASGRTFSKYAMGWFRQAPGKEREFVSH<br>ISRDGGRTFSSSTMGWFRQAPGKERELVALITPSSRTTYY-<br>ADSVKGRFTISA<br>DNSKNTAYLQMNSLKPEDTAVYYCAIAGRGRWGQGTLVTVSS |
| 9-5 | 2601 | EVQLVESGGGLVQPGGSLRLSCAASGRTFRRYAMGWFRQAPGKEREFVAS<br>INWGGGNTYYADSVKGRFTISADNSKNTAYLQMNSLKPEDTAVYYCAKT<br>KRTGIFTTARMVDWGQGTLVTVSS |
| 9-6 | 2602 | EVQLVESGGGLVQPGGSLRLSCAASGRTFSRFAMGWFRQAPGKEREFVAA<br>IRWSGGRTVYADSVKGRFTISADNSKNTAYLQMNSLKPEDTAVYYCAIEP<br>GTIRNWRNRVPFARGNFGWGQGTLVTVSS |
| 9-7 | 2603 | EVQLVESGGGLVQPGGSLRLSCAASGLGIAFSRRTAMGWFRQAPGKEREF<br>VAAISWRGGNTYYADSVKGRFTISADNSKNTAYLQMNSLKPEDTAVYYC<br>AARRWIPPGPIWGQGTLVTVSS |
| 9-8 | 2604 | EVQLVESGGGLVQPGGSLRLSCAASGRTFRRYPMGWFRQAPGKEREFVAA<br>ISRSGGSTYYADSVKGRFTISADNSKNTAYLQMNSLKPEDTAVYYCAAKR<br>LRSFASGGSYDWGQGTLVTVSS |
| 9-9 | 2605 | EVQLVESGGGLVQPGGSLRLSCAASGGTLRGYGMGWFRQAPGKEREFVA<br>SISRSGGSTYYADSVKGRFTISADNSKNTAYLQMNSLKPEDTAVYYCAARR<br>RVTLFTSRADYDWGQGTLVTVSS |
| 9-10 | 2606 | EVQLVESGGGLVQPGGSLRLSCAASGRMFSSRSMGWFRQAPGKEREFVAL<br>INRSGGSQFYADSVKGRFTISADNSKNTAYLQMNSLKPEDTAVYYCAARR<br>WIPPGPIWGQGTLVTVSS |
| 9-11 | 2607 | EVQLVESGGGLVQPGGSLRLSCAASGRTFGRRAMGWFRQAPGKEREFVA<br>GISRGGGTNYADSVKGRFTISADNSKNTAYLQMNSLKPEDTAVYYCAAKG<br>IWDYLGRRDFGDWGQGTLVTVSS |
| 10-1 | 2608 | EVQLVESGGGLVQPGGSLRLSCAASGLSSPPFDDFPMGWFRQAPGKEREFV<br>SSIYSDDGDSMYADSVKGRFTISADNSKNTAYLQMNSLKPEDTAVYYCAR<br>QTFDFWSASLGGNFWYFDLWGQGTLVTVSS |
| 10-2 | 2609 | EVQLVESGGGLVQPGGSLRLSCAASGGTFSSYSMGWFRQAPGKEREFVSAI<br>SWIIGSGGTTNYADSVKGRFTISADNSKNTAYLQMNSLKPEDTAVYYCTA<br>GAGDSWGQGTLVTVSS |
| 10-3 | 2610 | EVQLVESGGGLVQPGGSLRLSCAASGSIFSTRTMGWFRQAPGKEREFVASI<br>TKFGSTNYADSVKGRFTISADNSKNTAYLQMNSLKPEDTAVYYCTRGGGR<br>FFDWLYLRWGQGTLVTVSS |
| 10-4 | 2611 | EVQLVESGGGLVQPGGSLRLSCAASGRTLWRSNMGWFRQAPGKEREFVA<br>SISSFGSTKYADSVKGRFTISADNSKNTAYLQMNSLKPEDTAVYYCARGHG<br>RYFDWLLFARPPDYWGQGTLVTVSS |
| 10-5 | 2612 | EVQLVESGGGLVQPGGSLRLSCAASGRSLGIYRMGWFRQAPGKEREFVAA<br>ITSGGRKNYADSVKGRFTISADNSKNTAYLQMNSLKPEDTAVYYCAKRTIF<br>GVGRWLDPWGQGTLVTVSS |
| 10-6 | 2613 | EVQLVESGGGLVQPGGSLRLSCAASGTTLTFRIMGWFRQAPGKEREFVPAI<br>SSTGLASYTDSVKGRFTISADNSKNTAYLQMNSLKPEDTAVYYCSKDRAP<br>NCFACCPNGFDVWGQGTLVTVSS |
| 10-7 | 2614 | EVQLVESGGGLVQPGGSLRLSCAASGSRFSGRFNILNMGWFRQAPGKEREF<br>VARIGYSGQSISYADSVKGRFTISADNSKNTAYLQMNSLKPEDTAVYYCAR<br>GRFLGGTEWGQGTLVTVSS |
| 10-8 | 2615 | EVQLVESGGGLVQPGGSLRLSCAASGTLFKINAMGWFRQAPGKEREFVAQ<br>INRHGVTYYADSVKGRFTISADNSKNTAYLQMNSLKPEDTAVYYCARGRT<br>IFFGGGRYFDYWGQGTLVTVSS |
| 10-9 | 2616 | EVQLVESGGGLVQPGGSLRLSCAASGIPFRSRTMGWFRQAPGKEREFVAGI<br>TGSGRSQYYADSVKGRFTISADNSKNTAYLQMNSLKPEDTAVYYCARGAR<br>IFGSVAPWRGGNYYGMDVWGQGTLVTVSS |

TABLE 30-continued

Membrane Protein VH Sequences

| Variant | SEQ ID NO | VH |
|---|---|---|
| 10-10 | 2617 | EVQLVESGGGLVQPGGSLRLSCAASGFTFSSFRMGWFRQAPGKEREFVAGI SRGGSTNYADSVKGRFTISADNSKNTAYLQMNSLKPEDTAVYYCARASGL WFRRPHVWGQGTLVTVSS |
| 10-11 | 2618 | EVQLVESGGGLVQPGGSLRLSCAASGRNFRRNSMGWFRQAPGKEREFVAG ISWSGARTHYADSVKGRFTISADNSKNTAYLQMNSLKPEDTAVYYCARVS RRPRSPPGYYYGMDVWGQGTLVTVSS |
| 10-12 | 2619 | EVQLVESGGGLVQPGGSLRLSCAASGRNLRMYRMGWFRQAPGKEREFVA TIRWSDGSTYYADSVKGRFTISADNSKNTAYLQMNSLKPEDTAVYYCTRA RLRYFDWLFPTNFDYWGQGTLVTVSS |
| 10-13 | 2620 | EVQLVESGGGLVQPGGSLRLSCAASGGLTFSSNTMGWFRQAPGKEREFVA SISSSGRTSYADSVKGRFTISADNSKNTAYLQMNSLKPEDTAVYYCARRVR RLWFRSYFDLWGQGTLVTVSS |
| 10-14 | 2621 | EVQLVESGGGLVQPGGSLRLSCAASGFTLAYYAMGWFRQAPGKEREFVA AISWSGRNINYADSVKGRFTISADNSKNTAYLQMNSLKPEDTAVYYCARE RARWFGKFSVSWGQGTLVTVSS |
| 10-15 | 2622 | EVQLVESGGGLVQPGGSLRLSCAASGRTFSSFPMGWFRQAPGKEREFVAAI SWSGSTSYADSVKGRFTISADNSKNTAYLQMNSLKPEDTAVYYSACGRLG FGAWGQGTLVTVSS |
| 10-16 | 2623 | EVQLVESGGGLVQPGGSLRLSCAASGISSSKRNMGWFRQAPGKEREFVAT WTSRGITTYADSVKGRFTISADNSKNTAYLQMNSLKPEDTAVYYCARGGP PRLWGSYRRKYFDYWGQGTLVTVSS |
| 10-17 | 2624 | EVQLVESGGGLVQPGGSLRLSCAASGRTFSIYAMGWFRQAPGKEREFVARI TRGGITKYADSVKGRFTISADNSKNTAYLQMNSLKPEDTAVYYCARGLGW LLGYYWGQGTLVTVSS |
| 10-18 | 2625 | EVQLVESGGGLVQPGGSLRLSCAASGRMYNSYSMGWFRQAPGKEREFVA RISPGGTFYADSVKGRFTISADNSKNTAYLQMNSLKPEDTAVYYCTTSARS GWFWRYFDSWGQGTLVTVSS |
| 10-19 | 2626 | EVQLVESGGGLVQPGGSLRLSCAASGRTFRSYGMGWFRQAPGKEREFVAS ISRSGTTMYADSVKGRFTISADNSKNTAYLQMNSLKPEDTAVYYCARRGL LQWFGAPNSWFDPWGQGTLVTVSS |
| 10-20 | 2627 | EVQLVESGGGLVQPGGSLRLSCAASGRTIRTMGWFRQAPGKEREFVATINS RGITNYADSVKGRFTISADNSKNTAYLQMNSLKPEDTAVYYCTTERDGLL WFRELFRPSWGQGTLVTVSS |
| 10-21 | 2628 | EVQLVESGGGLVQPGGSLRLSCAASGRSFSFNAMGWFRQAPGKEREFVAR ISRFGRTNYADSVKGRFTISADNSKNTAYLQMNSLKPEDTAVYYCAKVHS YVWGGHSDYWGQGTLVTVSS |
| 10-22 | 2629 | EVQLVESGGGLVQPGGSLRLSCAASGRTYYAMGWFRQAPGKEREFVGAID WSGRRITYADSVKGRFTISADNSKNTAYLQMNSLKPEDTAVYYCARVRFS RLGGVIGRPIDSWGQGTLVTVSS |
| 10-23 | 2630 | EVQLVESGGGLVQPGGSLRLSCAASGRAFRRYTMGWFRQAPGKEREFVAS ITKFGSTNYADSVKGRFTISADNSKNTAYLQMNSLKPEDTAVYYCAKDRG VLWFGELYWGQGTLVTVSS |
| 10-24 | 2631 | EVQLVESGGGLVQPGGSLRLSCAASGRTFSNYRMGWFRQAPGKEREFVAS INRGGSTKYADSVKGRFTISADNSKNTAYLQMNSLKPEDTAVYYCASGKG GSATIFHLSRRPLYFDYWGQGTLVTVSS |
| 10-25 | 2632 | EVQLVESGGGLVQPGGSLRLSCAASGITFSPYAMGWFRQAPGKEREFVATI NWSGGYTVYADSVKGRFTISADNSKNTAYLQMNSLKPEDTAVYYCAKRK NRGPLWFGGGWGYWGQGTLVTVSS |
| 10-26 | 2633 | EVQLVESGGGLVQPGGSLRLSCAASGRTFSGFTMSSTWMGWFRQAPGKER EFVAGIITNGSTNYADSVKGRFTISADNSKNTAYLQMNSLKPEDTAVYYCA RRVAYSSFWSGLRKHMDVWGQGTLVTVSS |
| 10-27 | 2634 | EVQLVESGGGLVQPGGSLRLSCAASGRTFRRYSMGWFRQAPGKEREFVAS ITPGGNTNYADSVKGRFTISADNSKNTAYLQMNSLKPEDTAVYYCASRRR WLTPYIFWGQGTLVTVSS |

TABLE 30-continued

Membrane Protein VH Sequences

| Variant | SEQ ID NO | VH |
|---|---|---|
| 10-28 | 2635 | EVQLVESGGGLVQPGGSLRLSCAASGSIFSIGMGWFRQAPGKEREFVARIWWRSGATYYADSVKGRFTISADNSKNTAYLQMNSLKPEDTAVYYCAAISIFGRLKWGQGTLVTVSS |
| 10-29 | 2636 | EVQLVESGGGLVQPGGSLRLSCAASGRTFTSYRMGWFRQAPGKEREFVAEISSSGGYTYYADSVKGRFTISADNSKNTAYLQMNSLKPEDTAVYYCARVGPLRFLAQRPRLRPDYWGQGTLVTVSS |
| 10-30 | 2637 | EVQLVESGGGLVQPGGSLRLSCAASGRTFSSFRFRAMGWFRQAPGKEREFVALIFSGGSTYYADSVKGRFTISADNSKNTAYLQMNSLKPEDTAVYYCAREWGRWLQRGSYWGQGTLVTVSS |
| 10-31 | 2638 | EVQLVESGGGLVQPGGSLRLSCAASGRTFGSYGMGWFRQAPGKEREFVATISIGGRTYYADSVKGRFTISADNSKNTAYLQMNSLKPEDTAVYYCARGSGSGFMWYHGNNNYDRWRYWGQGTLVTVSS |
| 10-32 | 2639 | EVQLVESGGGLVQPGGSLRLSCAASGRTFRSYPMGWFRQAPGKEREFVASINRGGSTNYADSVKGRFTISADNSKNTAYLQMNSLKPEDTAVYYCARGRYDFWSGYYRWFDPWGQGTLVTVSS |
| 10-33 | 2640 | EVQLVESGGGLVQPGGSLRLSCAASGRTFSRSDMGWFRQAPGKEREFVAAISWSGGSTSYADSVKGRFTISADNSKNTAYLQMNSLKPEDTAVYYCATVPPPRRFLEWLPRRLTYIWGQGTLVTVSS |
| 10-34 | 2641 | EVQLVESGGGLVQPGGSLRLSCAASGRTFRRYTMGWFRQAPGKEREFVASMRGSRSYYADSVKGRFTISADNSKNTAYLQMNSLKPEDTAVYYCARMSGFPFLDYWGQGTLVTVSS |
| 10-35 | 2642 | EVQLVESGGGLVQPGGSLRLSCAASGSIFRLSTMGWFRQAPGKEREFVASISSFGSTYYADSVKGRFTISADNSKNTAYLQMNSLKPEDTAVYYCARTRGIFLWFGESFDYWGQGTLVTVSS |
| 10-36 | 2643 | EVQLVESGGGLVQPGGSLRLSCAASGIAFRIRTMGWFRQAPGKEREFVASITSGGSTNYADSVKGRFTISADNSKNTAYLQMNSLKPEDTAVYYCARGGPRFGGFRGYFDPWGQGTLVTVSS |
| 10-37 | 2644 | EVQLVESGGGLVQPGGSLRLSCAASGFTFTSYRMGWFRQAPGKEREFVAGISRFFGTAYYADSVKGRFTISADNSKNTAYLQMNSLKPEDTAVYYCARVTRWFGGLDVWGQGTLVTVSS |
| 10-38 | 2645 | EVQLVESGGGLVQPGGSLRLSCAASGRTFSRYVMGWFRQAPGKEREFVASISRFGRTNYADSVKGRFTISADNSKNTAYLQMNSLKPEDTAVYYCARHHGLGILWWGTMDVWGQGTLVTVSS |
| 10-39 | 2646 | EVQLVESGGGLVQPGGSLRLSCAASGRTFSMGWFRQAPGKEREFVASISRFGRTNYADSVKGRFTISADNSKNTAYLQMNSLKPEDTAVYYCAKRSTWLPQHFDSWGQGTLVTVSS |
| 10-40 | 2647 | EVQLVESGGGLVQPGGSLRLSCAASGRTFSTYTMGWFRQAPGKEREFVARIWRSGGNTYYADSVKGRFTISADNSKNTAYLQMNSLKPEDTAVYYCARGVRGVFRAYFDHWGQGTLVTVSS |
| 10-41 | 2648 | EVQLVESGGGLVQPGGSLRLSCAASGRNLRMYRMGWFRQAPGKEREFVALISRVGVTSYADSVKGRFTISADNSKNTAYLQMNSLKPEDTAVYYCARGTSFFNFWSGSLGRVGFDSWGQGTLVTVSS |
| 10-42 | 2649 | EVQLVESGGGLVQPGGSLRLSCAASGITIRTHAMGWFRQAPGKEREFVATISRSGGNTYYADSVKGRFTISADNSKNTAYLQMNSLKPEDTAVYYCTTAGVLRYFDWFRRPYWGQGTLVTVSS |
| 10-43 | 2650 | EVQLVESGGGLVQPGGSLRLSCAASGRTFRRYHMGWFRQAPGKEREFVAAITSGGRTNYADSVKGRFTISADNSKNTAYLQMNSLKPEDTAVYYCTTDGLRYFDWFPWASAFDIWGQGTLVTVSS |
| 10-44 | 2651 | EVQLVESGGGLVQPGGSLRLSCAASGRTFRRYTMGWFRQAPGKEREFVAVISWSGGSTKYADSVKGRFTISADNSKNTAYLQMNSLKPEDTAVYYCARKGRWSGMNVWGQGTLVTVSS |
| 10-45 | 2652 | EVQLVESGGGLVQPGGSLRLSCAASGRTFSWYPMGWFRQAPGKEREFVASISWGGARTYYADSVKGRFTISADNSKNTAYLQMNSLKPEDTAVYYCARSTGPRGSGRYRAHWFDSWGQGTLVTVSS |

TABLE 30-continued

Membrane Protein VH Sequences

| Variant | SEQ ID NO | VH |
|---|---|---|
| 10-46 | 2653 | EVQLVESGGGLVQPGGSLRLSCAASGRTFTSYRMGWFRQAPGKEREFVAA ITWNSGRTRYADSVKGRFTISADNSKNTAYLQMNSLKPEDTAVYYCSPSS WPFYFGAWGQGTLVTVSS |
| 10-47 | 2654 | EVQLVESGGGLVQPGGSLRLSCAASGRPLRRYVMGWFRQAPGKEREFVA AITNGGSTKYADSVKGRFTISADNSKNTAYLQMNSLKPEDTAVYYCARGT PWRLLWFGTLGPPPAFDYWGQGTLVTVSS |
| 10-48 | 2655 | EVQLVESGGGLVQPGGSLRLSCAASGRTFRRYAMGWFRQAPGKEREFVA AINRSGSTEYADSVKGRFTISADNSKNTAYLQMNSLKPEDTAVYYCARQH QDFWTGYYTVWGQGTLVTVSS |
| 10-49 | 2656 | EVQLVESGGGLVQPGGSLRLSCAASGRTFRRYTMGWFRQAPGKEREFVAS ISRSGTTYYADSVKGRFTISADNSKNTAYLQMNSLKPEDTAVYYCAKEGW RWLQLRGGFDYWGQGTLVTVSS |
| 10-50 | 2657 | EVQLVESGGGLVQPGGSLRLSCAASGRTLSTYNMGWFRQAPGKEREFVAS ISRFGRTNYADSVKGRFTISADNSKNTAYLQMNSLKPEDTAVYYCARRGK LSAAMHWFDPWGQGTLVTVSS |
| 10-51 | 2658 | EVQLVESGGGLVQPGGSLRLSCAASGRFFSTRVMGWFRQAPGKEREFVAR IWPGGSTYYADSVKGRFTISADNSKNTAYLQMNSLKPEDTAVYYCARDRG IFGVSRWGQGTLVTVSS |
| 10-52 | 2659 | EVQLVESGGGLVQPGGSLRLSCAASGRFFSICSMGWFRQAPGKEREFVAGI NWRSGGSTYYADSVKGRFTISADNSKNTAYLQMNSLKPEDTAVYYCARG SGWWEYWGQGTLVTVSS |
| 10-53 | 2660 | EVQLVESGGGLVQPGGSLRLSCAASGRMFSSRSNMGWFRQAPGKEREFVA SISSGGTTAYADSVKGRFTISADNSKNTAYLQMNSLKPEDTAVYYCARGFG RRFLEWLPRFDYWGQGTLVTVSS |
| 10-54 | 2661 | EVQLVESGGGLVQPGGSLRLSCAASGRTFSSARMGWFRQAPGKEREFVAG INMISSTKYADSVKGRFTISADNSKNTAYLQMNSLKPEDTAVYYCAHFRRF LPRGYVDYWGQGTLVTVSS |
| 10-55 | 2662 | EVQLVESGGGLVQPGGSLRLSCAASGRTFRRYTMGWFRQAPGKEREFVAR IAGGSTYYADSVKGRFTISADNSKNTAYLQMNSLKPEDTAVYYCARQQYY DFWSGYFRSGYFDLWGQGTLVTVSS |
| 10-56 | 2663 | EVQLVESGGGLVQPGGSLRLSCAASGHTFRNYGMGWFRQAPGKEREFVA AITSSGSTNYADSVKGRFTISADNSKNTAYLQMNSLKPEDTAVYYCATVPP PRRFLEWLPRRLTYTWGQGTLVTVSS |
| 10-57 | 2664 | EVQLVESGGGLVQPGGSLRLSCAASGRTFSRYAMGWFRQAPGKEREFVAS ITKFGSTNYADSVKGRFTISADNSKNTAYLQMNSLKPEDTAVYYCAKERES RFLKWRKTDWGQGTLVTVSS |
| 10-58 | 2665 | EVQLVESGGGLVQPGGSLRLSCAASGRNLRMYRMGWFRQAPGKEREFVA SISRFGRTNYADSVKGRFTISADNSKNTAYLQMNSLKPEDTAVYYCARHDS IGLFRHGMDVWGQGTLVTVSS |
| 10-59 | 2666 | EVQLVESGGGLVQPGGSLRLSCAASGRTFRRYAMGWFRQAPGKEREFVAR ISSGGSTSYADSVKGRFTISADNSKNTAYLQMNSLKPEDTAVYYCARDRGF GFWSGLRGYFDLWGQGTLVTVSS |
| 10-60 | 2667 | EVQLVESGGGLVQPGGSLRLSCAASGIPASMYLGWFRQAPGKEREFVAAIT SGGRTSYADSVKGRFTISADNSKNTAYLQMNSLKPEDTAVYYCAKRKKRG PLWFGGGGWGYWGQGTLVTVSS |
| 10-61 | 2668 | EVQLVESGGGLVQPGGSLRLSCAASGIPFRSRTFSAYAMGWFRQAPGKERE FVAQITRGGSTNYADSVKGRFTISADNSKNTAYLQMNSLKPEDTAVYYCA RRHWFGFDYWGQGTLVTVSS |

Example 12. SARS-CoV-2 S Protein Ectodomain in Complex with a Bispecific Antibody This experiment evaluated bispecific antibodies for effector functions (e.g. Fc gamma receptor and C1q binding), neonatal Fc receptor binding, and inhibition of ACE2-SARS-CoV-2 spike protein interaction. The goal of this experiment was to assess the potential for effector function of antibody 493-004 using a panel of Fc receptor binding assays. The study also assessed the ability of antibody 493-004 to inhibit the ACE2/SARS-CoV-2 spike protein binding interaction.

Antibody 493-004 is a synthetic, humanized, anti-SARS-CoV-2 spike protein receptor-binding domain (RBD) bispecific monoclonal antibody comprised of two different variable heavy chains (VHH) linked together with the constant heavy chain 2 (CH2) and the constant heavy chain 3 (CH3) human IgG1 Fc regions. Antibody 493-004 does not contain a variable light chain (FIG. 23).

To identify and construct this bispecific antibody with binding regions capable of binding and neutralizing the SARS-CoV-2 virus and known variants of concern, an approach was deployed that included the screening and epitope binning of numerous VHH antibodies using high-throughput surface plasmon resonance (SPR). This is a real-time binding kinetics assay which calculates the apparent equilibrium dissociation constant (KD) based on increasing concentrations of SARS-CoV-2 S Trimer or S1 monomer protein injections into the assay. From this screen, two distinct VHH leads were identified: first, antibody 202-03 was selected and following the emergence of the delta variant, the second lead, antibody 339-031 was selected. The resulting traces of the first VHH, antibody 202-03 in the SPR assays demonstrating binding to the SARS-CoV-2 variants of concern (VOC) at that time, are presented in FIG. 28.

Following the completion of the binding assays and characterization of binding kinetics for the two VHH antibodies, a series of functional, cell-based assays were initiated. The mean fluorescence intensity (MFI) was determined by subjecting the antibodies to flow cytometry assays to measure inhibition of S1 binding to Vero E6 cells, which constitutively express African Green monkey ACE2. Vero E6 cells were aliquoted in 96-well plates at $1.5 \times 10^5$ cells per well. Antibodies were diluted in PBS and serial diluted 1:3 from 100 nM. Antibody dilutions were then mixed with 1 µg/ml S1 RBD-mFc (Acro SPD-05259) equally, and incubated at 4° C. for 1 hr. The antibody and S1 RBD-mFc mixture then were added to Vero E6 cells, incubated at 4° C. for 1 hr, and washed 3× in PBS. APC-conjugated anti-mouse antibody was then aliquoted and incubated for 1 hr at 4° C. Cells were analyzed by flow by measuring the APC signal.

Interpretively, the assays are assessing the binding of S1 receptor binding domain (RBD) fused to mouse Fc (and variants) to Vero E6 cells expressing ACE2 and detection is via APC-conjugated secondary anti-mouse antibody. Increasing concentrations of inhibitory antibody leads to lower levels of binding. From these assays, the inhibitory concentration at 50% (IC50) was determined for each assay (Table 31).

TABLE 31

IC50 Values Calculated from Cross Reaction Competition Assays.

| SARS-CoV-2 Variant/ VHH Antibody | IC50 (nM) | |
| --- | --- | --- |
| | Antibody 202-03 | Antibody 339-031 |
| S1 RBD fusion (Wuhan/WT) | 0.9043 | 1.248 |
| Alpha | 0.8912 | 0.9901 |
| Beta | 0.5868 | >100 |
| Epsilon, CA_L452R | 5.141 | 1.401 |

During the VHH screening campaigns conducted, the alpha and beta variants were used in place of the original Wuhan spike protein. Additionally, with the emergence of the delta variant, both the variant (when available) and several surrogates with the L452R mutation, were integrated into the screening and functional assays. As shown in Table 31, antibody 339-031 had improved activity against Epsilon, which has the L452R mutation, but had reduced activity against Beta.

To better understand and assess the potential for the two selected VHH antibodies (202-03 and 339-031) to compete with each other for the same binding regions, epitope binning experiments on SPR were performed to determine whether binding of antibody 202-03 will block binding of antibody 339-031, and vice versa, to SARS-CoV-2 S Trimers. Epitope binning SPR experiments were performed on a Carterra LSA SPR biosensor equipped with a HC30 M chip at 25° C. in HBS-TE. Briefly, antibodies were diluted to 10 µg/mL and amine-coupled to the sensor chip by EDC/NHS activation, followed by ethanolamine HCl quenching. Binding test and regeneration scouting showed reproducible binding to SARS-CoV-2 S Trimer at 10 nM using IgG elution buffer (Thermo). Premixes were then assembled with 150 nM antibody and 10 nM SARS-CoV-2 S Trimer. Data were analyzed in Carterra's Epitope Tool software. Competition assignments were determined relative to the binding responses for SARS-CoV-2 S1 alone (normalized to 1).

From this data, heatmaps representing the pair-wise epitope binning were generated using both WA1 S Trimer and Delta S Trimer and are presented in FIG. 31. The list of antibodies along the rows represent the immobilized antibody and those listed along the columns are the analyte antibody premixed with S Trimer. The specific VHH antibodies antibody 202-03 and antibody 339-031 are indicated by the arrows. The color coding represents red=competition, yellow=partial competition, and green=non-competitive. These data demonstrated that antibody 202-03 and antibody 339-031 have some partial overlap in their epitope bins. Both antibody 202-03 and antibody 339-031 show complete competition with themselves in both experiments.

Following the characterization of the VHH antibodies through competitive binding experiments and the generation of the heat maps, a series of experiments were conducted using pseudovirus to determine the neutralization ability of the individual antibodies. To perform these experiments, pseudovirus expressing the various SARS-CoV-2 spike protein mutations were utilized, representing the current variants of concern. Briefly, the ability to neutralize vesicular stomatitis virus (VSV) pseudotyped with the SARS-CoV-2 D614G spike glycoprotein variant (i.e., a VSV encoding the SARS-CoV-2 D614G spike variant) and all the other variants of concern (see FIG. 32) was tested. Two separate surrogates for the delta variant were used in these experiments, each expressing the L452R mutation.

The results of these experiments demonstrate and further substantiate the strong binding affinity and neutralization ability of both VHH antibodies, with calculated EC50 values at or below 0.1 ug/ml in most cases. There was reduced apparent binding affinity observed with the VHH antibody 202-03 to variants expressing the L452R mutation (e.g., Epsilon California strains; B.1.427 and B.1.429), however, this was mitigated by the affirmative apparent binding affinity and neutralization of the second VHH antibody 339-031 to these variants (with EC50 values at 0.2 and <0.1 ug/ml, respectively, for the two Epsilon/California strains. FIG. 33 and Table 32 provide a summary of the pseudovirus data as described.

TABLE 32

Results of pesudovirus Testing of VHH antibodies.

| Antibody | D614G | Alpha | Beta | Gamma | Epsilon-427 | Epsilon-429 |
|---|---|---|---|---|---|---|
| 202-03 | 0.049 | 0.049 | 0.003 | 0.002 | >10 | >10 |
| 339-031 | 0.036 | <0.1 | <0.1 | <0.1 | 0.219 | <0.1 |

Based on all the characterization and performance data for the two VHH antibodies, a decision was made to construct a single bispecific antibody using the 202-03 and 339-031 antibodies. This strategy was selected over a standard cocktail approach with individual VHH antibodies as a bispecific antibody may offer greater overall potency and therapeutic benefits for patients. A final bispecific construct named antibody 493-004 (see FIG. 23 for schematic) was made.

Following the characterization and determination of the binding kinetics for the constructed bispecific antibody 493-004, functional cell-based assays using pseudovirus for the L452R mutation were performed. As surrogates for this mutation, the surrogate Epsilon California variant was used with spike proteins B.1.427 and B.1.429. As shown in FIG. 34, the bispecific antibody neutralized the Epsilon variant for both spike proteins with EC50 values of 0.5443 and 0.5654 mg/ml, respectively.

In a separate pseudovirus assay using the Delta variant (B.1.617.2), a comparison between the individual VHH antibody 339-031 and the bispecific antibody 493-004 was performed. The results are presented in FIG. 35. As suspected from previous binding and neutralization data, both the VHH antibody and the bispecific antibody performed similarly in this assay. The calculated EC50 values were 0.08538 and 0.08136, respectively. In this assay, the VHH antibody 202-03 was not included as it has been shown in previous experiments to bind considerably less efficiently and therefore have limited neutralization potential against the delta variant.

Following the completion of pseudovirus testing, the ability of the bispecific antibody 493-004 to reduce infection with SARS-CoV-2 in a live virus model was tested. In addition to the bispecific antibody and similar to the approach taken with the pseudovirus testing, the VHH antibody 339-031 was also included in the live virus testing, along with a laboratory control (h2165).

An overview of the materials and methods used in the assay are presented below. For the viruses used in the assay and the cells, SARS-CoV-2 isolates were obtained from the Biodefense and Emerging Infections (BEI) Research Resources Repository or isolated at Saint Louis University. Virus stocks were generated by infecting Vero cells overexpressing human Ace2 and TMPRSS2 (VAT cells) at a multiplicity of infection of 0.005. Virus was harvested at 96 hours post infection, cellular debris was removed by centrifugation and virus was aliquoted and frozen at −80° C. Virus titer was determined by focus forming assay (FFA).

The assay deployed the use of Focus Reduction Neutralization Test or FRNT. Specifically, four-fold serial dilutions of the monoclonal antibodies were mixed with ~100 focus-forming units (FFU) of virus, incubated at 37° C. for 1 h, and added to VAT cell monolayers in 96-well plates for 1 h at 37° C. to allow virus adsorption. Cells were overlaid with 2% methylcellulose mixed with DMEM containing 5% FBS and incubated for 24 hours at 37° C. Media was removed and the monolayers were fixed with 5% paraformaldehyde in PBS for 15 min at room temperature, rinsed, and permeabilized in Perm Wash (PBS, 0.05% Triton-X). Infected cell foci were stained by incubating cells with polyclonal anti-SARS Guinea Pig sera for 1 h at 37° C. and then washed three times with Perm Wash. Foci were detected after the cells were incubated with a 1:5000 dilution of horseradish peroxidase-conjugated goat anti-guinea pig IgG (Sigma) for 1 hour. After three washes with Perm Wash, staining was visualized by addition of TrueBlue detection reagent (KPL). Infected foci were then enumerated by CTL Elispot. FRNT curves were generated by log-transformation of the X axis followed by non-linear curve fit regression analysis using Graphpad Prism 8 (FIG. 36).

Consistent with the results obtained from the pseudovirus testing, the bispecific antibody 493-004 demonstrated superior performance and ability to reduce infection when compared to the individual VHH antibody 339-031. Of interest, when looking at the effect of these antibody constructs in cells infected with the Delta variant, the contributory effect of the second VHH antibody 202-03 (used in the construct of the bispecific) can be seen by the difference between the two curves from the VHH antibody 339-031 and the bispecific antibody TB493-04. This is not surprising because although the VHH antibody 202-03 has an apparent reduced binding affinity and neutralization potential against variants expressing the L452R mutation, there is a contributory effect observed when this VHH antibody is in the bispecific construct.

Comparing the neutralization potential of the bispecific antibody 493-004 to the individual VHH antibody 339-031 against the wild type (AZ1), Beta, and Delta variants of SARS-CoV-2, it is clear that the bispecific demonstrates improved neutralization potential as shown by reductions in $FRNT_{50}$ values across wild type and the two variants of concern tested. This is highlighted by the bar graph in FIG. 37.

Consistent with the results obtained from the pseudovirus testing, the bispecific antibody 493-004 demonstrated superior performance and ability to reduce infection when compared to the individual VHH antibody 339-031. Of interest, when looking at the effect of these antibody constructs in cells infected with the Delta variant, the contributory effect of the second VHH antibody 202-03 (used in the construct of the bispecific) can be seen by the difference between the two curves from the VHH antibody 339-031 and the bispecific antibody 493-004. This is not surprising because it has been shown previously that although the VHH antibody 202-03 has an apparent reduced binding affinity and neutralization potential against variants expressing the L452R mutation, there is a contributory effect observed when this VHH antibody is in the bispecific construct.

Comparing the neutralization potential of the bispecific antibody 493-004 to the individual VHH antibody 339-031 against the wild type (AZ1), Beta, and Delta variants of SARS-CoV-2, it is clear that the bispecific demonstrates improved neutralization potential as shown by reductions in FRNT50 values across wild type and the two variants of concern tested (FIG. 37).

Table 33 shows a Fc fusion bispecific antibody developed against SARS-CoV-2 spike protein for the treatment of COVID-19. Antibody 493-004 contains an unmodified human IgG1 Fc.

Results showed that antibody 493-004 showed binding to the neonatal Fc receptor (FcRn), Fcγ receptors and C1q similar to those of an isotype-matched positive control IgG1 antibody. Results also found that antibody 493-004 showed inhibition of the Ancestral spike RBD as well as SARS-CoV-2 spike trimers of Ancestral, Delta, and Omicron variants.

Wild-type forms of human IgG1 have the potential to bind various Fcγ receptors and elicit effector function. For example, Fcγ receptors on immune cells may mediate recruitment and activation of these cells toward cells or tissues where antibody is bound to antigen, resulting in antibody-dependent cell-mediated cytotoxicity (ADCC). Similarly, complement component 1q (C1q) can also recognize antibody-bound Fc regions and mediate a process called complement-dependent cytotoxicity (CDC). The lower hinge region (amino acid 233-239) of the human IgG1 Fc is known to be important for its Fcγ receptor (FcγR) binding and complement binding. In this in vitro study, the potential for antibody 493-004-mediated effector function was evaluated using a panel of Fc binding assays with recombinant proteins (FcγR, FcRn, and C1q). The ability of antibody 493-004 to inhibit the ACE2/SARS-CoV-2 spike binding interaction using Ancestral, Delta and Omicron spike variants was also evaluated.

TABLE 33

Sequences of Fc Fusion Bispecific Antibody 493-004

| Variant | SEQ ID NO | Sequence |
|---|---|---|
| Antibody 493-004 DNA Sequence | 2669 | ATGGGATGGTCATGTATCATCCTTTTTCTGGTAGCAACTGCAAC TGGAGTACATAGCGAGGTGCAGCTGGTCGAGTCTGGCGGTGGC TTGGTGCAACCCGGCGGCAGCTTGAGACTGTCTTGCGCCGCCTC CGGGTTCACCTTCTCCCCAAGTTGGATGGGATGGTTTCGGCAAG CCCCAGGCAAGGAACGCGAATTCGTGGCCACTATCAATGAATA CGGCGGCCGGAACTACGCCGACTCCGTGAAAGGGCGATTTACA ATTTCCGCTGATAACTCCAAGAACACCGCATATCTGCAAATGAA CAGCCTCAAGCCTGAGGACACAGCCGTCTACTATTGTGCTAGAG TGGACCGGGACTTTGACTACTGGGGTCAGGGTACACTGGTTACG GTTTCCTCGGGAGGAGGCGGAAGCGAACCCAAGTCTTCTGACA AAACTCACACATGCCCACCGTGCCCAGCACCTGAACTCCTGGG GGGACCGTCAGTCTTCCTCTTCCCCCCAAAACCCAAGGACACCC TCATGATCTCCCGGACCCCTGAGGTCACATGCGTGGTGGTGGAC GTGAGCCACGAAGACCCTGAGGTCAAGTTCAACTGGTACGTGG ACGGCGTGGAGGTGCATAATGCCAAGACAAAGCCGCGGGAGG AGCAGTACAACAGCACGTACCGTGTGGTCAGCGTCCTCACCGTC CTGCACCAGGACTGGCTGAATGGCAAGGAGTACAAGTGCAAGG TCTCCAACAAAGCCCTCCCAGCCCCCATCGAGAAAACCATCTCC AAAGCCAAAGGGCAGCCCCGAGAACCACAGGTGTACACCCTGC CCCCATCCCGGGAGGAGATGACCAAGAACCAGGTCAGCCTGAC CTGCCTGGTCAAAGGCTTCTATCCCAGCGACATCGCCGTGGAGT GGGAGAGCAATGGGCAGCCGGAGAACAACTACAAGACCACGC CTCCCGTGCTGGACTCCGACGGCTCCTTCTTCCTCTACAGCAAG CTCACCGTGGACAAGAGCAGGTGGCAGCAGGGGAACGTCTTCT CATGCTCCGTGATGCATGAGGCTCTGCACAACCACTACACGCAG AAGAGCCTCTCCCTGTCTCCGGGCGGCGGAGGTGGATCTGGGG GCGGCGGTTCCGCTTCTGAGGTTCAGCTCGTAGAATCCGGTGGA GGACTTGTTCAACCTGGAGGTAGTCTGAGGCTGAGCTGTGCTGC AAGTGGCAGCACATTTAGCATCAATGCTATGGGTTGGTTCCGAC AAGCTCCAGGGAAGGAGCGCGAGTTCGTGGCTGGGATCACCAG CTCTGGAGGCTATACCAACTACGCTGACTCTGTCAAAGGTCGCT TTACCATATCGGCCGACAATTCTAAGAATACTGCCTACCTGCAA ATGAACTCCCTGAAGCCTGAAGACACCGCCGTGTATTACTGCGC CGCTGATGGCGTGCCGGAGTACAGCGATTACGCGTCGGGACCA GTCTGGGGCCAAGGCACATGGTGACTGTATCGTCGTAATAG |
| Antibody 493-004 AA Sequence | 2670 | MGWSCIILFLVATATGVHSEVQLVESGGGLVQPGGSLRLSCAAS GFTFSPSWMGWFRQAPGKEREFVATINEYGGRNYADSVKGRF TISADNSKNTAYLQMNSLKPEDTAVYYCARVDRDFDYWGQGT LVTVSSGGGGSEPKSSDKTHTCPPCPAPELLGGPSVFLFPPKPKDTL MISRTPEVTCVVVDVSHEDPEVKFNWYVDGVEVHNAKTKPREEQ YNSTYRVVSVLTVLHQDWLNGKEYKCKVSNKALPAPIEKTISKAK GQPREPQVYTLPPSREEMTKNQVSLTCLVKGFYPSDIAVEWESNG QPENNYKTTPPVLDSDGSFFLYSKLTVDKSRWQQGNVFSCSVMHE ALHNHYTQKSLSLSPGGGGGSGGGGSASEVQLVESGGGLVQPGG SLRLSCAASGSTFSINAMGWFRQAPGKEREFVAGITSSGGYTNY ADSVKGRFTISADNSKNTAYLQMNSLKPEDTAVYYCAADGVPE YSDYASGPVWGQGTLVTYSS\*\* |

A biosensor-based binding assay was carried out using surface plasmon resonance (SPR) detection, to quantitatively evaluate the binding affinities of Fc receptors (panel of FcγR proteins and FcRn) for antibody 493-004, an anti-SARS-CoV-2 Spike RBD quadrivalent bispecific VHH-Fc fusion (from human IgG1). An isotype-matched commercially sourced anti-RBD neutralizing monoclonal antibody (human IgG1) from Acro Biosystems (SAD-S35) was used as a positive control in these experiments.

Interaction analysis was conducted on a Biacore 8K biosensor equipped with CM5 sensor chip at 25° C. in the standard run buffer of HBS—P, pH 7.4 with 0.2 g/L BSA (for FcγR panel) or PBS—P, pH 6.0 with 0.2 g/L of BSA (Dulbecco phosphate buffer saline with 0.01% Tween-20 adjusted to pH 6.0 using dilute phosphoric acid) for analysis of FcRn interaction, respectively. Neutravidin (ThermoFisher Scientific, MA, US, Cat #31000) was coated onto all flow cells of the chip at high levels (~8000 RUs) using a standard amine-coupling procedure and then coated with high levels of biotinylated SARS-CoV-2 spike RBD (~6000 RUs). The RBD-coated chip was utilized as a 'capture surface' to capture (tether) appropriate amounts of antibody 493-004 (~80-500 RUs) on flow cell 2 (the active surface) with flow cell 1 left empty, representing the naked RBD-coated surface, to serve as a reference surface. Binding of Fc receptors (as analytes) to antibody 493-004 (as ligand) was evaluated by injecting Fc receptors in increasing concentrations over flow cells 1 and 2 at 30 μL/min using the 'single cycle kinetics' module. Analyte titrations used were 5-(or 6-)membered, 3-fold serial dilutions with top concentration of 30 nM (FcγR1), 300 nM (FcRn), 1000 nM (FcγR2a and 3a) or 3000 nM (FcγR2b/c). Within the same experiment, the binding of Fc receptors (as analytes) to flow cells tethered with a commercially sourced isotype-matched anti-RBD neutralizing antibody (as ligand), served as a positive control. Blank cycles using buffer (instead of Fc receptors) as analyte were used for double-referencing the binding data. After each binding cycle, the ligands (antibody 493-004 or the control antibody) were stripped from the RBD-coated surface by regenerating it with 10 mM glycine, pH2.0 for 30 s (for the FcγR interactions) or with PBS—P pH7.4 for 1 min (for the FcRn interactions).

Biacore data were processed and analyzed in the BiaEvaluation™ software. Biacore data for antibody 493-004 or the isotype-matched (human IgG1) control anti-RBD neutralizing antibody binding to the Fc receptors were fit globally to a simple 1:1 Langmuir binding model to calculate the kinetics parameters, including the association and dissociation kinetic rate constants (Ka and Kd) and the affinity constant (also known as the equilibrium dissociation constant, or KD) from their ratio, where KD=Kd/Ka. The binding data were also fitted, where appropriate, to a steady state affinity model to generate binding isotherms to obtain KD using this alternate equilibrium-based model. All interactions except those of the 'high affinity' FcγR1 met the criteria for steady state fitting, which requires that all sensorgrams attain equilibrium binding responses during the allowed association phase per analyte injection. All experiments were repeated for a total of 3 times and values are reported as mean±SD.

An ELISA-based binding assay was used to evaluate the ability of antibody 493-004 to bind complement C1q. Native human IgG1, IgG2 and IgG4 isolated from human plasma were used as positive controls in the ELISA. A purified human IgG1 isotype control recombinant monoclonal antibody (clone QA16A12) from Biolegend was also used as positive control in this experiment.

The binding of human C1q (Prospec, NJ, US) to antibody 493-004 and control antibodies (native human IgG1, native human IgG2, native human IgG4 and Biolegend recombinant human IgG1 clone QA16A12) was assessed by ELISA.

A Nunc Maxisorp flat bottom ELISA plate was absorption-coated overnight with antibody 493-004 and control antibodies (native human IgG1, native human IgG2, native human IgG4 and Biolegend human IgG1 clone QA16A12) at a concentration of 2 μg/ml (15 nM molecules) in PBS at 4° C. Subsequently, the wells were washed and blocked using START-Block buffer for 1 h at room temperature. Dose titrated C1q (20 μg/mL, 2 fold dilution in START-Block buffer) was added to the appropriate wells and incubated at room temperature for 1 h with gentle shaking. This was followed by addition of polyclonal sheep anti-human C1q antibody conjugated to horseradish peroxidase (0.5 μg/mL, 1 h incubation) to detect C1q bound to the coated antibodies. The plate was developed by addition of TMB substrate. The reaction was stopped by the addition of ELISA stop solution and the OD was measured at 492 nm using Envision 2105 multimode plate reader (Perkin Elmer, CT, US). Experiments were repeated in triplicate and the binding data was fitted in GraphPad Prism™ using nonlinear regression-4PL.

A biochemical inhibition assay was carried out using AlphaLISA to quantitatively evaluate the inhibition of the binding interaction between ACE2 and SARS-CoV-2 spike protein by antibody 493-004, antibody 339-031, and antibody 202-03 (antibody 339-031 and antibody 202-03 are bivalent monospecific parent VHH-Fc fusions from which the quadrivalent bispecific antibody 493-004 is derived). The anti-RBD neutralizing monoclonal antibody from Acro Biosystems and ACE2-His were used as positive controls in these experiments.

The inhibition of the ACE2/SARS-CoV-2 spike binding interaction by antibody 493-004 was carried out using AlphaLISA.

Initial experiment was designed to identify optimal conditions of ACE2-muFc complex formation with biotinylated SARS-CoV-2 spike RBD recombinant protein. For this purpose, a cross-titration experiment was set up whereby different concentrations of ACE2-muFc (100-0.14 nM, 3-fold dilution) was cross-titrated against different concentrations of biotinylated SARS-CoV-2 spike RBD (100-0.14 nM, 3-fold dilution) in a checkerboard format. Each concentration combination of ACE2-muFc and biotin spike RBD were mixed in a 384-well Proxiplate™. Streptavidin donor beads (final concentration of 40 μg/mL) and anti-mouse IgG acceptor beads (final concentration of 10 μg/mL) were then added to the wells. The samples were incubated at room temperature, in the dark for 1 h. AlphaLISA signal was read using Envision 2105 multimode plate reader equipped with AlphaLISA optical module (Perkin Elmer, CT, US).

Similar cross-titrations were carried out between ACE2-mu Fc and biotinylated SARS-CoV-2 spike trimers from Ancestral (D614G), Delta, and Omicron (B.1.1.529) variants to identify optimal concentrations of complex formation between ACE2 and the respective spike trimers.

A quantitative inhibition of ACE2-SARS-CoV2 spike protein interaction by antibody 493-004, antibody 339-031, and antibody 202-03 (antibody 339-031 and antibody 202-03 are parent Fc fusions from which the bispecific antibody 493-004 is derived) was assessed by AlphaLISA. The anti-RBD neutralizing monoclonal antibody from Acro Biosystems and ACE2-His were used as positive controls in these experiments.

Based on the cross-titration experiment described above, appropriate concentration of ACE2-muFc was allowed to complex with optimal concentrations of biotinylated SARS-CoV2 spike proteins [i.e. Ancestral RBD, and trimers from Ancestral (D614G), Delta, and Omicron (B.1.1.529)] by incubating them together (ACE2-muFc+each separate spike variant) in the assay buffer (PBS, 0.01% P20, 0.2 mg/mL BSA, pH7.4) at room temperature for 1 h. The complex (5 µL) was then added to the 384-well Proxiplate™. This was followed by addition of 5 µL of the inhibitors (antibody 493-004, antibody 339-031, antibody 202-03, anti-RBD, ACE2-His) in a dose titration. Streptavidin donor beads (final concentration of 40 µg/mL) and anti-mouse IgG acceptor beads (final concentration of 10 µg/mL) were then added to the wells. The samples were incubated at room temperature, in the dark for 1 h. AlphaLISA signal was read using Envision 2105 multimode plate reader (Perkin Elmer, CT, US) equipped with AlphaLISA optical module. Inhibition experiments were repeated in triplicate and dose dependent curves fitted using non-linear regression-4PL [GraphPad Prism™]. IC50 values are reported as mean±SD.

Figure 13:
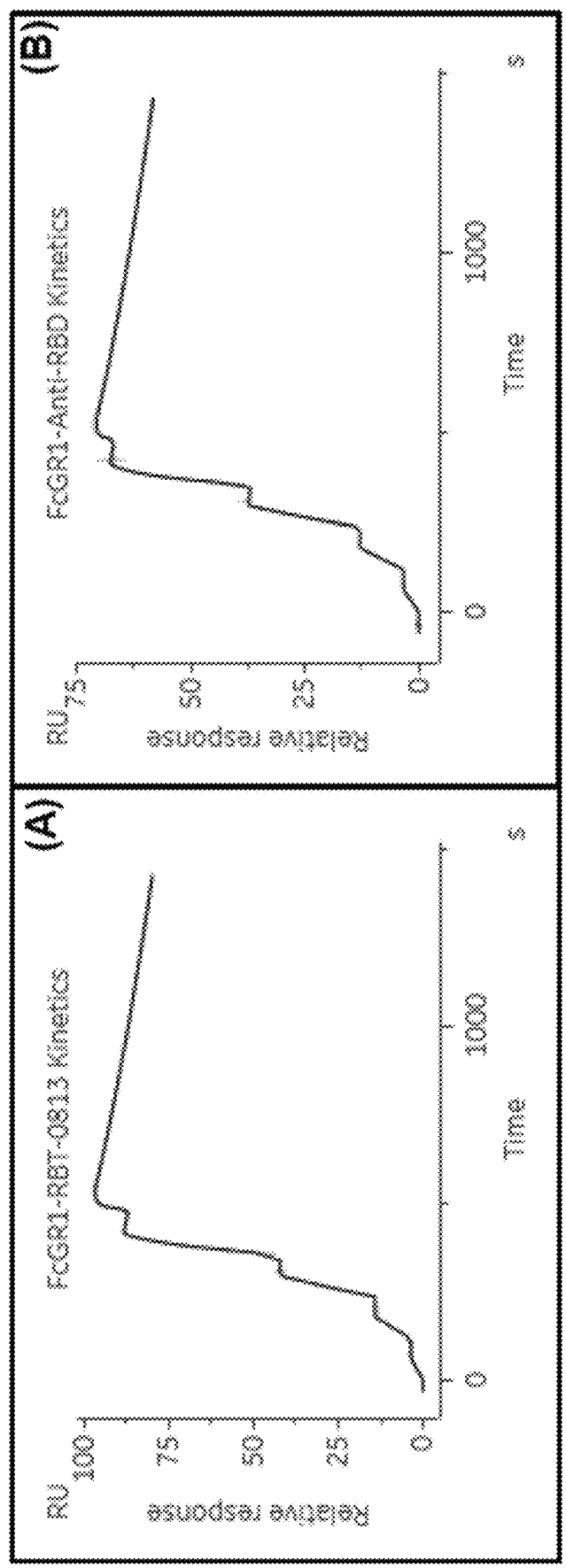
FIG. 13 shows Fc-gamma Receptor 1 (FcγR1) as an analyte was titrated (0.37-30 nM, 3-fold dilutions, 5-membered series) over antibody 493-004 (275RU) as ligand (Panel A) and anti-RBD isotype control (278RU) as ligand (Panel B), tethered via RBD-coated chip surface. The sensorgram view shows an example of an overlay plot of the measured data superposed with the global kinetic fit from a single experiment used to deduce the KD value.
Figure 14:
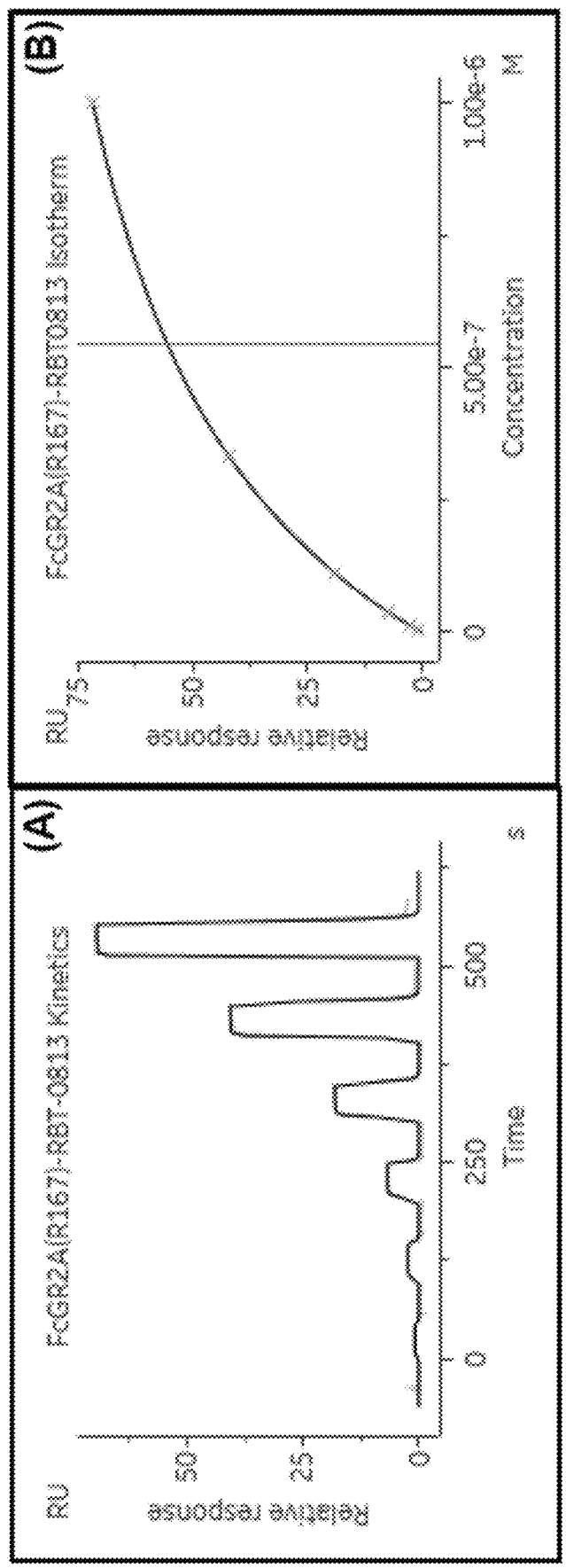
FIG. 14 shows FcγR2a R167 as an analyte was titrated (4.1-1000 nM, 3-fold dilutions, 6-membered series) over antibody 493-004 (510RU) as ligand, tethered via RBD-coated chip surface. Example of KD values determined via alternate fitting methods; (Panel A) kinetic model and (Panel B) steady-state binding isotherm.
Figure 15:
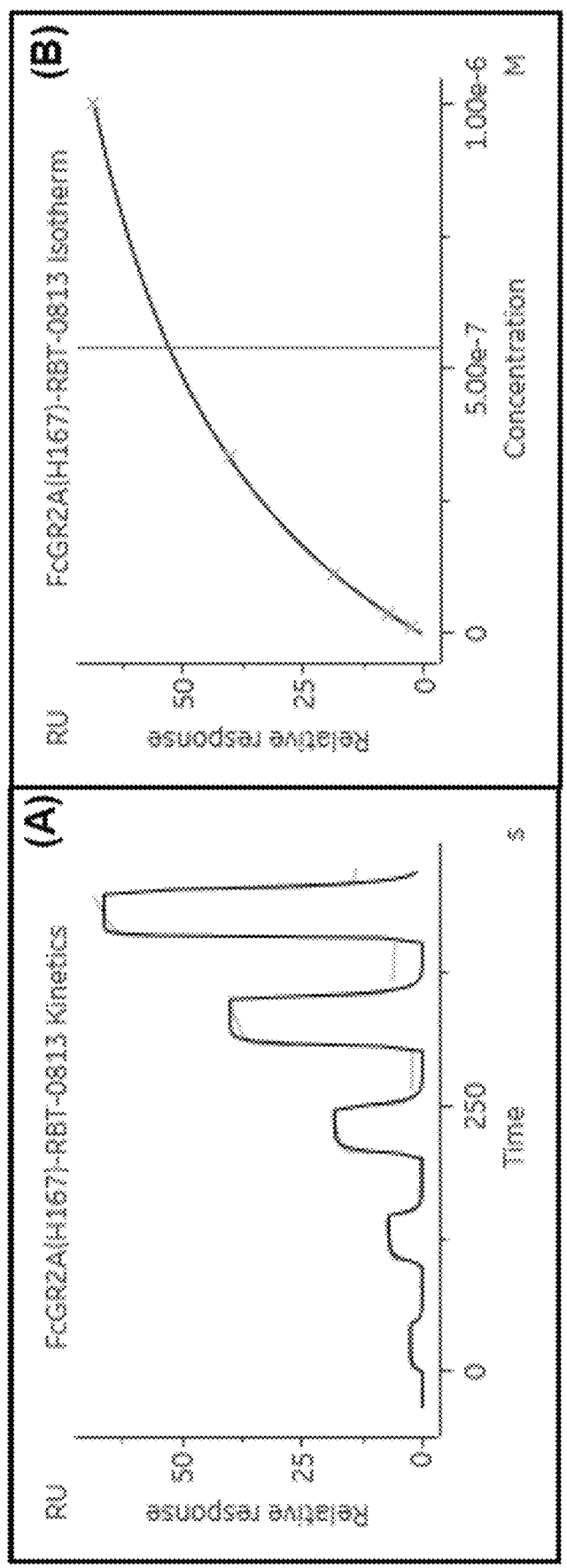
FIG. 15 shows FcγR2a H167 as an analyte was titrated (12.3-1000 nM, 3-fold dilutions, 5-membered series) over antibody 493-004 (488RU) as ligand, tethered via RBD-coated chip surface. Example of KD values determined via alternate fitting methods; (Panel A) kinetic model and (Panel B) steady-state binding isotherm.
Figure 16:
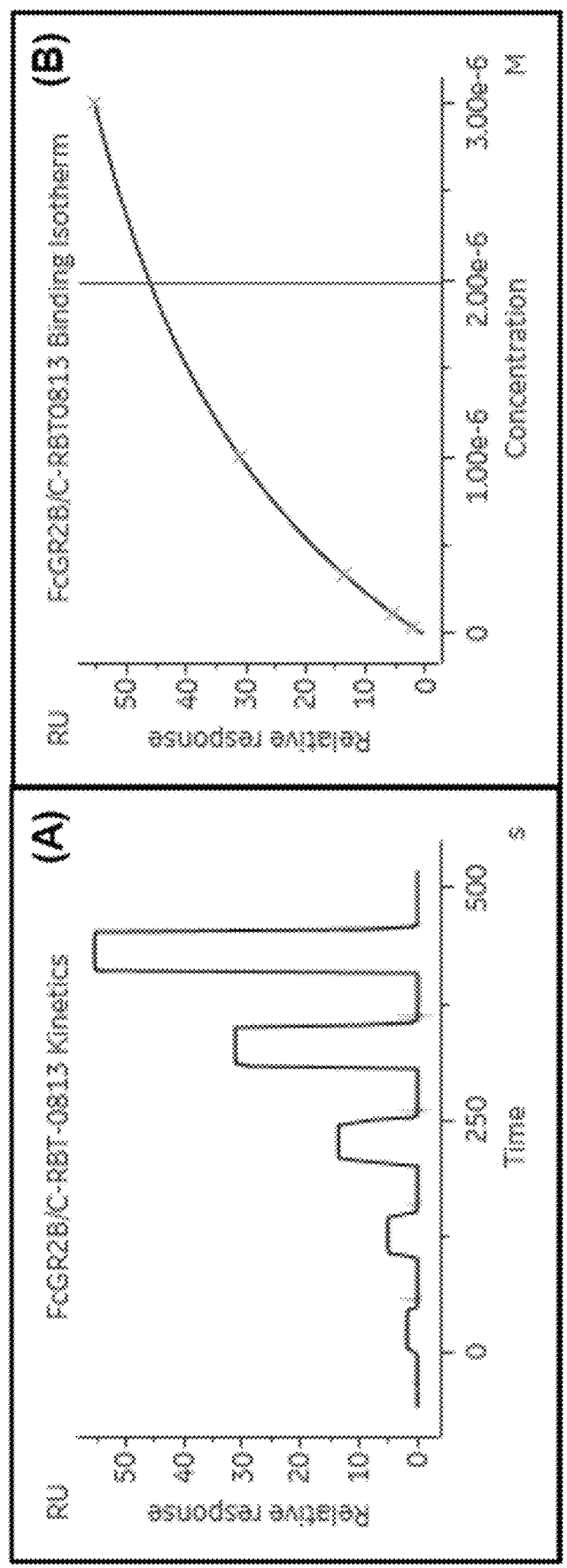
FIG. 16 shows FcγR2B/C as analyte was titrated (37-3000 nM, 3 fold dilutions, 5-membered series) over antibody 493-004 (510RU) as ligand, tethered via RBD-coated chip surface. Example of KD values determined via alternate fitting methods; (Panel A) kinetic model and (Panel B) steady-state binding isotherm.
Figure 17:
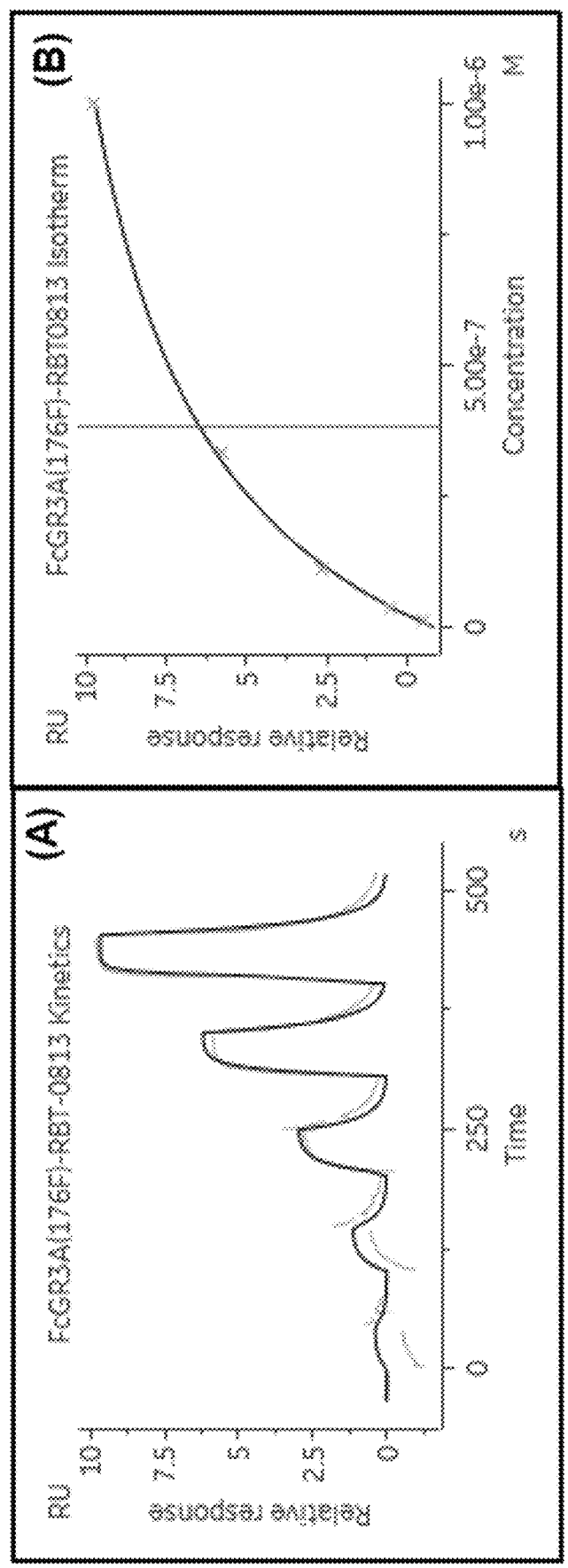
FIG. 17 shows FcγR3A 176F as analyte was titrated (12.3-1000 nM, 3-fold dilutions, 5-membered series) over antibody 493-004 (79RU) as ligand, tethered via an RBD-coated chip surface. Example of KD values determined via alternate fitting methods; (Panel A) kinetic model and (Panel B) steady-state binding isotherm.
Figure 18:
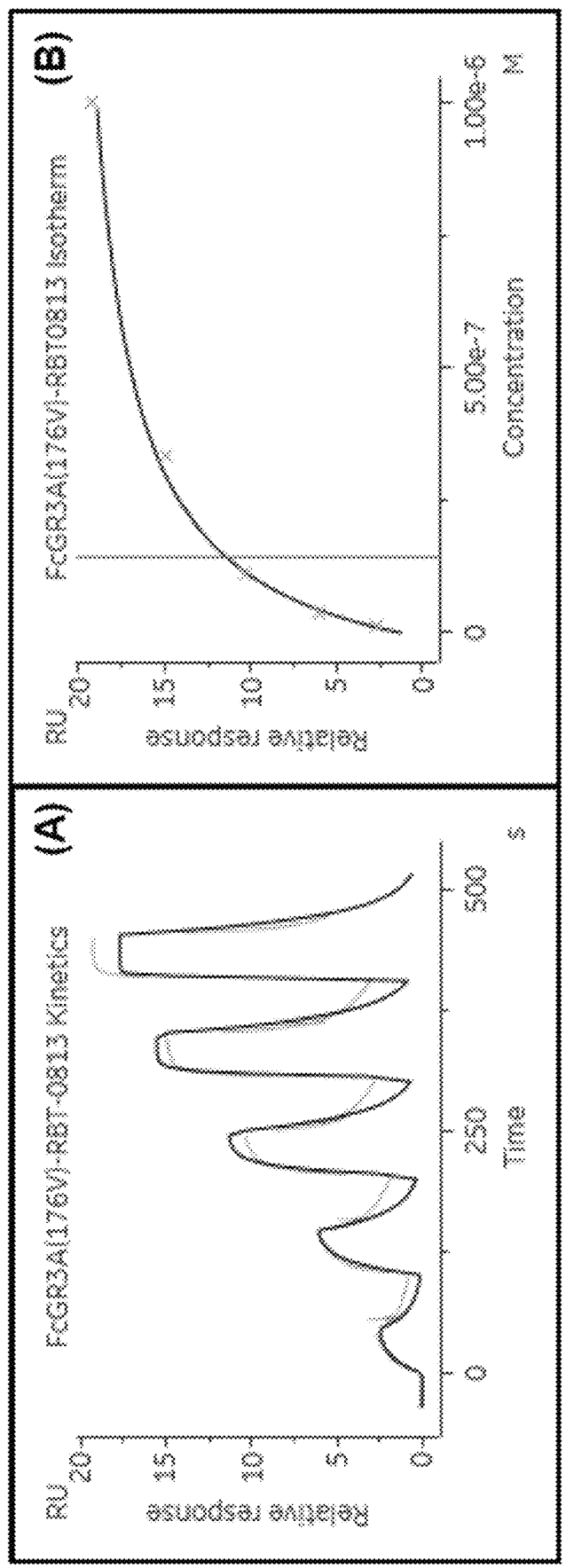
FIG. 18 shows FcγR3A 176V as analyte was titrated (12.3-1000 nM, 3-fold dilutions) over antibody 493-004 (79RU) as ligand, tethered via RBD-coated chip surface. Example of KD values determined via alternate fitting methods; (Panel A) kinetic model and (Panel B) steady-state binding isotherm.

The SPR based binding interactions of antibody 493-004 and anti-RBD neutralizing antibody (isotype control) with 'high affinity' FcγR1 are shown in FIG. 13 and the deduced binding kinetics and KD values derived from the Langmuir 1:1 binding model (kinetic fit) are reported in Table 34. The results show that the parameter values for FcγR1 interactions with antibody 493-004 and the isotype control were identical within the error of the measurements (Table 34).

The SPR based binding interactions of antibody 493-004 and anti-RBD neutralizing antibody (isotype control) with 'low affinity' Fc receptors is shown in FIGS. 14-18 and the deduced KD values derived from the Langmuir 1:1 binding model (kinetic fit) and steady state affinity model (steady state fit) are summarized in Table 35. Both binding models estimate comparable KD values for each studied Fc receptor interaction. The only discrepancy observed was for FcγR3a (176V) binding and is likely due to the heterogeneous quality of the commercial protein as judged by the markedly heterogeneous sensorgrams (FIG. 18), resulting in a poor KD estimate from the kinetic fit. When comparing antibody 493-004 to the isotype control, Table 35 shows that the affinities of all 'low affinity' Fc receptors studied were within 2-fold or better. Taken together, Table 34 and Table 35 show that antibody 493-004 retains the Fc receptor engagement properties that are characteristic of a human IgG1, hence, are expected to function similarly in vivo in this regard.

Figure 19:
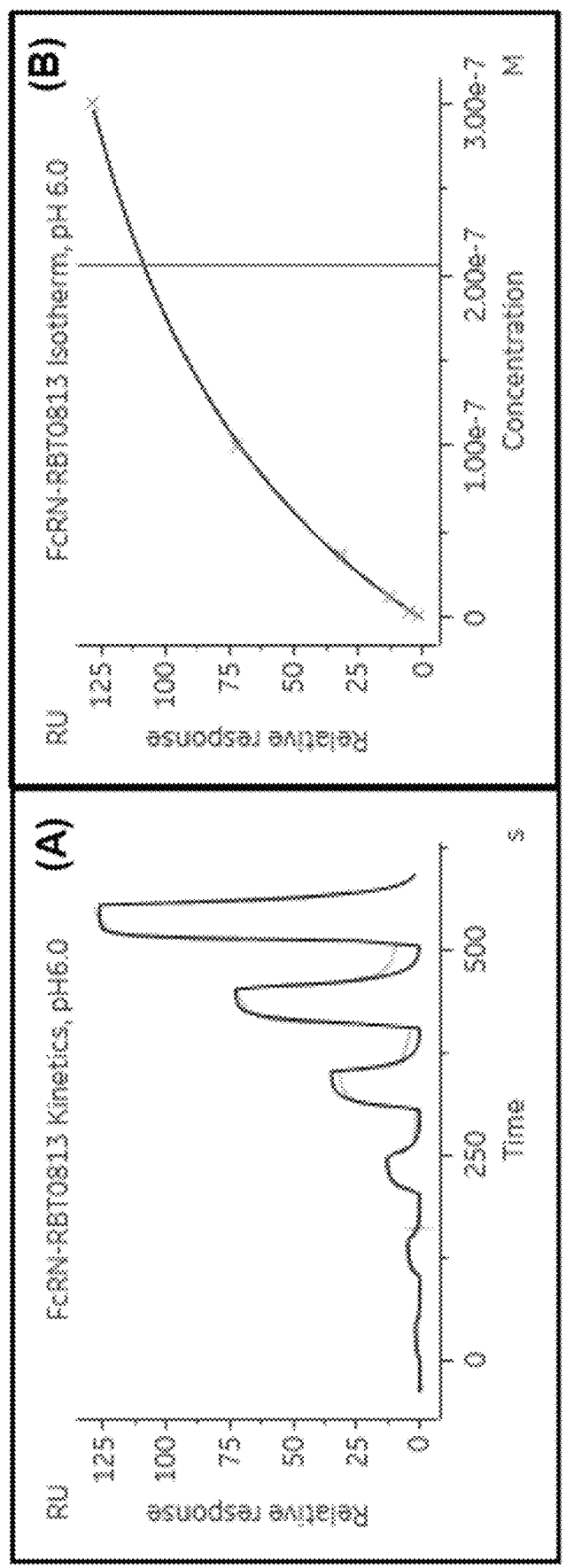
FIG. 19 shows the neonatal Fc receptor (FcRn) as analyte was titrated (1.4-300 nM, 3-fold dilutions, 6-membered series) over antibody 493-004 (216RU) as ligand, tethered via RBD-coated chip surface. Example of KD values determined via alternate fitting methods; (Panel A) kinetic model and (Panel B) steady-state binding isotherm.

The half-life of therapeutic antibodies can be prolonged by virtue of interactions with the neonatal receptor, FcRn, at acidic pH in serum. To probe this interaction, the binding of FcRn was tested (as analyte) to antibody 493-004 (as ligand) at pH6.0 (FIG. 19). antibody 493-004 shows similar binding kinetics and affinity for FcRn as those for an isotype-matched (human IgG1) anti-RBD neutralizing antibody (positive control) (Table 34), hence is expected to exhibit a serum half-life equivalent to that for a wild-type human IgG1. Table 34 and Table 35 also report 'apparent' % activity (ratio of experimental Rmax to theoretical Rmax) for all interactions tested. The reported % activity values were calculated using experimental Rmax obtained from kinetic fitted data (Table 34 and Table 35). Similar % activity values were also obtained when this ratio was calculated using experimental Rmax from steady state fits (data not shown). For all interactions tested, the fitted Rmax values were close to the theoretical ones (% activity was around 100%), thereby validating the assay set up and overall quality/reliability of the assay.

TABLE 34

Kinetic and Affinity Determination of the 'High Affinity' FcγR1 Binding to Antibody 493-004 and Anti-RBD Isotype Control.

| Ligand (on Chip) | ka (M − 1 s − 1) | kd (s − 1) | KD (pM) | % Activity |
|---|---|---|---|---|
| antibody 493-004 | (4.50 ± 0.46) × 106 | (2.46 ± 0.01) × 10 − 4 | 550 ± 7 | 118 |
| Anti-RBD Isotype Control | (5.34 ± 0.15) × 106 | (2.45 ± 0.02) × 10 − 4 | 460 ± 10 | 120 |

The parameter values represent the mean±SD of 3 independent measurements. The 'apparent' % Activity was calculated as the ratio of experimental Rmax (obtained from kinetic fitting) to the theoretical Rmax. Theoretical Rmax values were calculated according to the binding stoichiometries of the analyte/ligand interactions, which are (on a per molecule basis) 1:1 for FcγR1 (one analyte per whole homodimer ligand).

TABLE 35

Affinity Determination of Fc Receptor Binding to Antibody 493-004 and Isotype-Matched Control Anti-RBD Neutralization Antibody by SPR.

| | Antibody 493-004 KD (nM) | | | Anti-RBD Isotype Control KD (nM) | | |
|---|---|---|---|---|---|---|
| Fc receptor (Analyte) | Kinetic Fit | Steady State Fit | % Activity | Kinetic Fit | Steady State Fit | % Activity |
| H167) FcγR2a | 487 ± 2.1 | 544 ± 6.4 | 99 | 462 ± 24 | 537 ± 17 | 110 |
| FcγR2a (R167) | 539 ± 12.1 | 550 ± 6.5 | 103 | 596, 650 (n = 2) | 636, 640 (n = 2) | ND |
| FcγR2b/c | 1950 ± 90 | 2010 ± 64 | 91 | 1360 ± 28 | 1590 ± 40 | 93 |
| FcγR3a (176F) | 399 ± 17.6 | 368 ± 15.5 | 75 | 1110 ± 45.7 | 796 ± 13.6 | 92 |
| FcγR3a (176V) | 75.3 ± 1.5 | 147 ± 5 | 107 | 161 ± 3.7 | 210 ± 1 | 110 |
| Human FcRn (at pH6.0) | 162 ± 10 | 195 ± 9.4 | 109 | 81.1 ± 1.5 | 86.5 ± 2.1 | 116 |

The parameter values represent the mean±SD of 3 independent measurements, except for FcγR2a (R167) which was analyzed twice and both values are reported. n/a=not applicable. 'Apparent" % Activity was calculated as the ratio of experimental Rmax (obtained from kinetic fitting) to the theoretical Rmax. Theoretical Rmax values were calculated according to the binding stoichiometries of the analyte/ligand interactions, which are (on a per molecule basis) 1:1 for FcγR1 (one analyte per whole homodimer ligand) and 2:1 for FcRn (two analytes per whole homodimer ligand, or one analyte per ligand monomer). ND=not determined.

Figure 20:
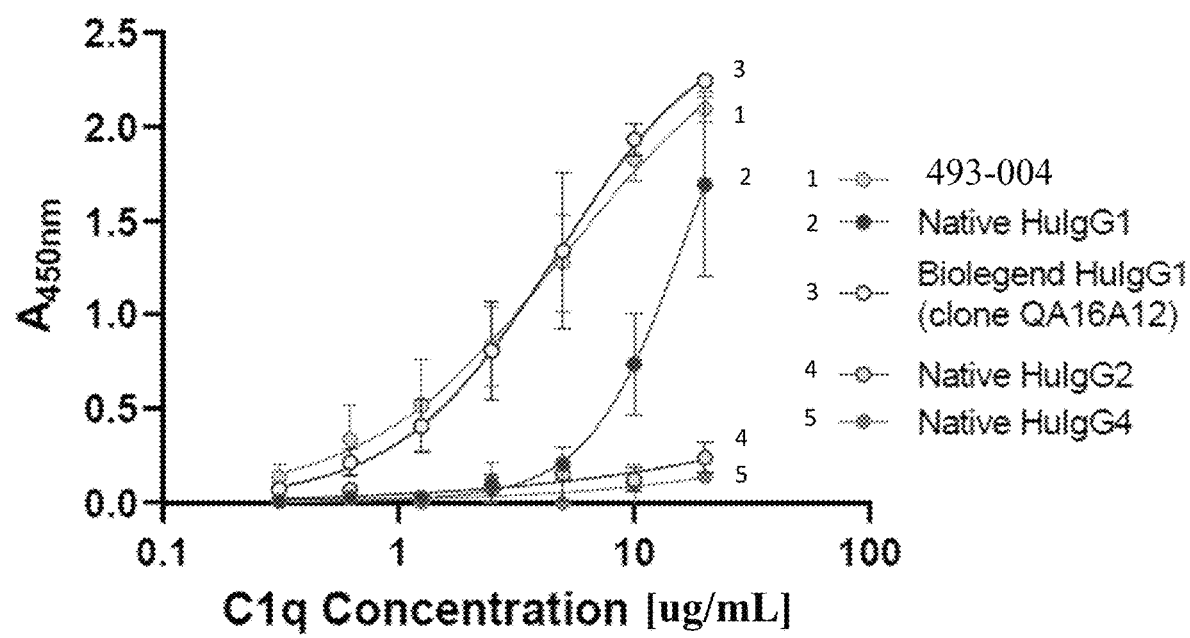
FIG. 20 shows a direct comparison of complement component C1q binding to ELISA plates adsorbed with antibody 493-004 (IgG1) and control antibodies of various isotypes (IgG1, IgG2, and IgG4).

Recombinant Clone QA16A12 (human IgG1) and native human IgG1 showed high dose dependent binding to C1q, while native human IgG2 and IgG4 showed low C1q binding (FIG. 20), in agreement with the literature. antibody 493-004 showed high, dose dependent binding to C1q similar to that for Clone QA16A12 human IgG1 (FIG. 20), suggesting comparable C1q engagement as a human IgG1 isotype. The difference in C1q binding between antibody 493-004 (and Clone QA16A12) and native human IgG1, despite having same Fc backbone is likely due to lower adherence of the latter to the ELISA plate during the different steps of the ELISA.

The ability of antibody 493-004 to inhibit the binding interaction between ACE2 and various forms of SARS-CoV-2 spike protein was determined quantitatively using AlphaLISA.

Figure 21:
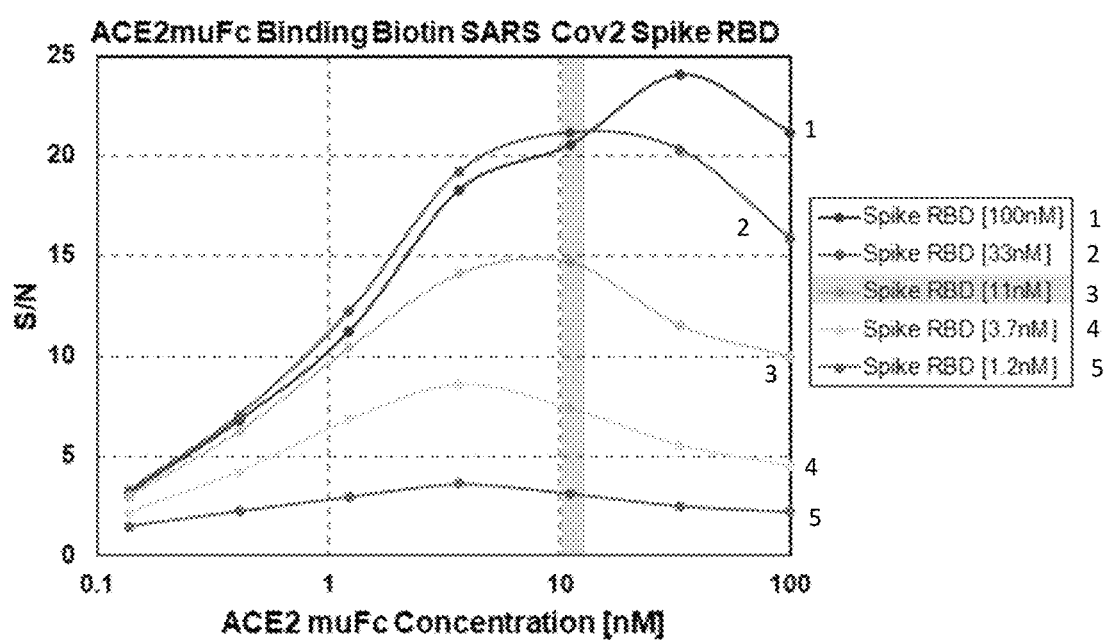
FIG. 21 shows signal-to-background ('signal-to-noise' or S/N) ratio data for complex formation between ACE2-muFc and biotinylated SARS-CoV2 spike RBD. The optimal concentrations of ACE2 (highlighted portion of the graph)

To develop the assay conditions, the optimal concentrations of ACE2-muFc and biotinylated SARS-CoV-2 spike RBD (Ancestral) for complex formation were determined using a cross-titration experiment in a matrix format (FIG. 21). Based on the results from this experiment, binding of ACE2-muFc (11 nM, highlighted by the vertical bar in the graph) with RBD (11 nM, highlighted in green in the legend) gave a 20-fold signal-to-noise (S/N) (FIG. 21) which was considered an optimal binding signal for setting up a subsequent inhibition assay. Similar cross-titration experiments between ACE2-muFc (11 nM) and biotinylated D614G SARS-CoV-2 spike trimer (11 nM) resulted in 30-fold S/N (data not shown). ACE2-mu Fc (11 nM) binding to SARS-CoV-2 spike trimers for Delta and Omicron (B.1.1.529) variants (33 nM) resulted in 17-fold and 25-fold S/N respectively (data not shown). These optimized binding conditions were utilized to prepare complexes of ACE2 with different variants of SARS-CoV-2 spike proteins to examine the inhibition of the interaction by antibody 493-004, parent VHH-Fc fusions (antibody 339-031 and antibody 202-03) and positive controls (Anti-RBD neutralizing antibody and ACE2-His) (FIG. 22).

Antibody 493-004 showed comparable potency to the commercially sourced control anti-RBD neutralizing antibody in inhibition of ancestral spike RBD and D614G spike trimer (Table 36). Unlike the control anti-RBD antibody, antibody 493-004 also exhibited inhibition of the interaction of ACE2 to Delta and Omicron spike trimers (FIG. 22) and exhibited similar potency in comparison to ACE2-His (positive control) (Table 36). Antibody 202-03 showed weak inhibition of the Delta spike trimer (FIG. 22, Panel C) at high concentrations, and antibody 339-031 showed no inhibition of Omicron spike trimer (FIG. 22, Panel D). In the case of inhibition of the Omicron variant, a residual 30% binding to ACE2 was observed even at the highest concentration of inhibitors (350 nM). This residual binding likely relates to heterogeneous quality of the commercially sourced protein.

TABLE 36

Inhibition of ACE2 Interaction with Different Variants of SARS-CoV-2 Spike Proteins.

| Antibody (or Control) | IC50 (nM) |
|---|---|
| Inhibition of ACE2/SARS-CoV-2 Spike RBD (Ancestral) | |
| Antibody 493-004 | 10.4 ± 1.9 |
| Antibody 339-031 | 5.6 ± 0.84 |
| Antibody 202-03 | 8.3 ± 0.25 |
| Anti-RBD (Acro) | 6.8 ± 0.50 |
| ACE2-His | 11.5 ± 0.82 |
| Inhibition of ACE2/SARS-CoV-2 Spike Trimer (Ancestral) | |
| Antibody 493-004 | 2.1 ± 0.4 |
| Antibody 339-031 | 2.1 ± 0.34 |
| Antibody 202-03 | 4.0 ± 0.22 |
| Anti-RBD (Acro) | 1.84 ± 0.35 |
| ACE2-His | 6.65 ± 0.46 |
| Inhibition of ACE2/SARS-CoV-2 Spike Trimer (Delta) | |
| Antibody 493-004 | 8.8 ± 1.3 |
| Antibody 339-031 | 3.0 ± 0.5 |
| Antibody 202-03 | No inhibition |
| Anti-RBD (Acro) | No inhibition |
| ACE2-His | 8.4 ± 1.16 |
| Inhibition of ACE2/SARS-CoV-2 Spike Trimer (Omicron) | |
| Antibody 493-004 | 9.04 ± 0.46 |
| Antibody 339-031 | No inhibition |
| Antibody 202-03 | 5.16 ± 0.32 |
| Anti-RBD (Acro) | No inhibition |
| ACE2-His | 7.91 ± 1.2 |

Using a variety of in-vitro binding assays (SPR, ELISA, and AlphaLISA), antibody 493-004 was shown to be a potent ACE2 inhibitor and retains intact Fc functionality consistent with that of a human IgG1 isotype. Antibody 493-004 is a potent bispecific inhibitor of SARS-CoV-2 spike recombinant proteins [Ancestral RBD and spike trimer (D614G)] that also inhibits Delta and Omicron variants of the spike trimer, with similar potency as ACE2-His (control). Antibody 493-004 showed similar binding to C1q as the human IgG1 isotype control, hence will likely activate the complement pathway similarly to a human IgG1. Antibody 493-004 also showed similar affinity for interaction with Fcγ receptors and FcRn as the isotype-matched control anti-RBD neutralizing antibody (human IgG1 Fc). This suggests that antibody 493-004 is likely to exhibit similar in vivo activity in terms of Fc effector function and exhibit the long serum half-life (via the FcRn recycle/rescue pathway) characteristic of a human IgG1.

Example 13. Humanized Anti-SARS-CoV-2 S Protein Receptor Binding Domain VHH Bispecific Antibody for Treatment of COVID-19

This experiment aims to treat COVID-19 with humanized anti-SARS-CoV-2 antibodies. Antibody 493-004 is a single dose, formulated in either an intravenous and/or subcutaneous dosage form for injection.

The bispecific monoclonal antibody 493-004 is constructed with two individual, single domain VHH antibodies: antibody 202-03 and antibody 339-031 linked together with the constant heavy chain 2 (CH2) and the constant heavy chain 3 (CH3) Fc region of the antibody (FIG. 23). The resulting bispecific monoclonal antibody is derived from humanized antibody VHH single domain sequences with specific affinity to distinct binding motifs on the SARS-CoV-2 S1 spike protein. The two individual VHHs used in the construct of the bispecific antibody contain llama-derived sequences in the CDR1 and CDR2 regions with a human CDR3 sequence. The framework for the bispecific antibody is >95% human. The CDRs fit into a VHH framework in the same manner that CDRs fit into human heavy chain frameworks and the FC regions of the bispecific are human IgG 1 Fc, which is the most common form of human IgG.

The upstream manufacturing process is depicted in FIG. 24. The drug substance is expressed in Chinese Hamster Ovary (CHO) cells using a fed batch process. Cell culture process development occurs in progressively larger bioreactor sizes, starting at 250 ml size, culminating in a 500 L GMP. The first step in the USP is vial thaw, where cells from the Master Cell Bank (MCB) are thawed and transferred into an appropriate cell culture flask containing inoculum medium. The cells are then incubated throughout the cell expansion stage for the upstream process. This is followed by the second step of inoculum scale-up, where a series of passages are performed to obtain a sufficient number and density of cells to inoculate the bioreactor. Inoculum steps progress from 250 mL shake flasks and move through 1 L, 2.8 L, 50 L and 100 L, to the 500 L bag bioreactor.

Growth medium is used for seed culture in the 100 L bioreactor and an initial cell density is targeted to be in the range of 0.25 to $0.45 \times 10^6$ cells/mL. Cells from the 100 L bioreactor are transferred to the 500 L bioreactor to initiate the production culturing process, with a target cell density of 0.8 to $1.2 \times 10^6$ cells/mL.

Pre-harvest samples are tested for sterility, mycoplasma, adventitious virus in vitro, detection of MVM DNA by qPCR using Taqman Technology, and quantitation of viral contaminants by negative stain electron microscopy. After 8 to 14 days of cultivation in the production phase, the cell culture fluid is harvested.

The downstream manufacturing process is depicted in FIG. 25. FIG. 26 depicts the drug product process. During bulk drug substance thawing, pooling, and mixing, frozen drug substance is thawed at room temperature, protected from light, and then pooled into a container where it is mixed to homogeneity. The mixed material is tested for pH, protein concentration, bioburden, and endotoxin. During sterile filtration, the pooled drug substance is aseptically filtered from Grade C area via a peristaltic pump through two in series connected 0.22 µm sterile filters into a sterile single use bag in the Grade B area. Prior to and after sterile filtration, filter integrity testing is performed on both filters. During aseptic filling, stoppering, and capping, aseptic filling is performed inside the open restricted access barrier system (ORABS) unit, which fully encloses the filler and provides a Grade A environment. The ORABS unit separates the operator from the aseptic interior. All filling components are performed inside the open restricted access barrier system (ORABS) unit, which fully encloses the filler and provides a Grade A environment. The ORABS unit separates the operator from the aseptic interior. All filling components are performed periodically during the filling process. Filled vials are automatically stoppered with sterilized rubber stoppers inside the ORABS unit. The stoppered vials are capped with sterilized plastic aluminum flip-off caps. During visual inspection, bulk packaging and storage, a manual 100% visual inspection is performed on the filled vials by production personnel, followed by a statistically based acceptable quality limit (AQL) inspection by Quality Assurance. Release and stability samples are taken after visual inspection. The filled drug product vials are bulk packaged, labelled and stored at 2-8° C. Drug substance specifications for the pharmaceutical formulation of monoclonal antibody 493-004 can be found in FIG. 47.

A pharmacokinetic (PK) study is performed of the bispecific monoclonal antibody 493-004 following single intravenous infusion and subcutaneous injection into Sprague Dawley rats. This experiment evaluates the serum pharmacokinetics (PK) and immunogenicity (anti-drug antibodies, ADA) of the bispecific monoclonal antibody following a single intravenous infusion (IV) and subcutaneous injection (SC) administration in male and female SD rats; the bispecific monoclonal antibody is determined in serum up to day 56 post-dosing. The experimental design of the PK study can be found in FIG. 48A. Dose volume is determined based on body weight of the rats, which are weighed prior to dose administration. During IV infusion, the dose formulation is administered via tail vein.

Each blood sample is collected via jugular vein puncture (right jugular vein cannulation from the animals in Group 1). Actual sample collection times is recorded in the study records. The acceptable deviation of blood collection is ±1 min for sample collected within 1 hour post-dose and 5% of the nominal time for other timepoints. A sample collection schedule is shown in FIG. 48B.

From each treatment group, about 0.3 mL blood sample is collected at sampling time points. The actual sample collection times is recorded. All blood samples are collected into commercially available BD tubes containing polymer silica activator. After blood is collected, the tubes containing blood samples are rested at room temperature for at least 30 minutes. Then centrifugation at 4° C. for 10 minutes at 3200×g occurs within 1 hour after collection. The clarified serum is then collected after centrifugation. The samples are then quickly frozen under dry ice and stored at −60° C. or lower in a freezer until being transferred in dry ice to Immunology Laboratory of Bioanalysis Department using a qualified Enzyme-Linked Immuno Sorbent Assay (ELISA) method for analysis.

From each treatment group, an about 0.45 mL blood sample is collected at sampling time points. The actual sample collection times will be recorded. All blood samples are collected into commercially available BD tubes containing polymer silica activator. After blood is collected, the tubes containing blood samples are rested at room temperature for at least 30 minutes. Then centrifugation at 4° C. for 10 minutes at 3200×g occurs within 2 hours after collection. The clarified serum is then collected after centrifugation. The samples are be quickly frozen under dry ice and stored at −60° C. or lower in a freezer until being transferred in dry ice to Immunology Laboratory of Bioanalysis Department using a validated method for analysis.

Neutralization effectiveness of the bispecific antibody was determined against ancestral and both the Delta and omicron (BA.1) variants of the SARS-CoV-2 virus, resulting in dose response curves and associated 50% effective concentration (EC50) and 90% effective concentration (EC90) determination for each variant (FIG. 42).

Based on an EC90 against the Omicron variant using an in vitro plaque reduction assay, the effective concentration of antibody 493-004 is 3000 ng/mL or 3 ug/mL. From the two-week rat PK data, the projected concentration-time profile for humans for 3 mg/kg antibody 493-004 dose indicate that the concentrations of antibody 493-004 will remain above 3 ug/mL at least for 10 days and therefore, can be therapeutically meaningful as an effective treatment. Most recently, the rat PK study has completed and the plasma exposures across the entire 42-day study are now available. Taking the same 3000 ng/mL or 3 ug/mL value calculated from the in vitro plaque reduction assay assessing the efficacy of antibody 493-004 against the Omicron variant, the concentration of antibody 493-004 will remain above 3 ug/mL for approximately 21-days or 3-weeks (FIG. 43).

The allometric modeling for all methods utilized PK data from a single species (e.g., the rat) and overall, all four methods projected FIH dose of 493-004 comparatively higher than typically observed with non-COVID-19 antibodies but consistent with what has been both demonstrated, as well as reviewed and granted EUA for antibodies against the SARS-CoV-2 virus. Using 70 kg as the average human weight, the modeling predicts the range of a single human IV dose of 493-004 to be between 329 mg (4.7 mg/kg) and 637 mg (9.1 mg/kg). This is aligned with the proposed Phase 1 dosing scheme of 1 mg/kg (70 mg), 3 mg/kg (210 mg), 6 mg/kg (420 mg), and 10 mg/kg (700 mg) single IV dose in healthy volunteers to establish human PK and safety, as well as the proposed Phase 2a dosing scheme of 6 mg/kg (420 mg) and 10 mg/kg (700 mg) single IV dose in non-hospitalized patients with SARS-CoV-2 experiencing mild to moderate disease.

A good laboratory practices (GLP), 15-day once weekly intravenous infusion or subcutaneous injection repeated dose toxicity and toxicokinetic study in rats is performed with a 28-day recovery period. This experiment determines the potential toxicity of the bispecific monoclonal antibody 493-004 when administered once weekly to Sprague Dawley rat for 3 doses (Days 1, 8 and 15) by intravenous infusion (IV) or subcutaneous injection (SC), and to assess the reversibility, persistence, or delayed occurrence of toxic effects following a 28-Day recovery period. In addition, the toxicokinetics (TK) and immunogenicity (anti-drug antibody, ADA) of the bispecific monoclonal antibody 493-004 are evaluated. Liquid chromatography with mass spectrometry (LC-MS) or liquid chromatography with tandem mass spectrometry (LC-MS/MS) methods are used for the detection and quantitation of the amount of bispecific mAb in plasma samples.

A GLP, tissue cross-reactivity (TCR) study was performed with frozen normal human and Sprague Dawley rat tissues. The objective of this study was to determine the cross-reactivity of the bispecific monoclonal antibody 493-004 with frozen normal human and Sprague Dawley rat tissues.

In the Sprague Dawley rat tissues, no Biotin-493-004 bispecific antibody staining was observed at 1 µg/mL. Positive staining was observed at 25 µg/mL in the cytoplasm only of the histiocytes from 3/3 of the lymph nodes. The staining intensity was weak, and the staining frequency was "rare" to "rare to occasional." Positive staining was also observed in the cytoplasm of the thymic cells. The staining intensity was weak, and the staining frequency was "rare". There was no Biotin-493-004 bispecific antibody staining in other Sprague-Dawley rat tissues.

Given that the staining as relegated to the cytoplasm only in the histiocytes, it was concluded that the staining observed presents insignificant toxicological risk factor since the mechanism of action would preclude accessibility of the bispecific antibody 493-004 to cytoplasmic structures in vivo. Furthermore, and importantly, there were no untoward findings in the histopathology for the low, medium, and high dosages of the 21-day repeat-dose, IV infusion or subcutaneous (SC) injection GLP toxicology study in the rat, with a 28-day recovery period. The clean toxicology study provides direct, supportive evidence that the cytoplasmic staining in the histiocytes observed in the TCR study is of no toxicological significance.

The purpose of the toxicology study was to determine the potential toxicity of 493-004, a bispecific antibody targeting SARS-CoV-2 in order to prevent or treat coronavirus disease 19 (COVID-19), when administered once weekly to Sprague Dawley rats for 3 doses (Days 1, 8 and 15) by IV infusion or injection, to assess the reversibility, persistence, or delayed occurrence of toxic effects following a 28-Day recovery period. In addition, the toxicokinetics (TK) and immunogenicity (anti-drug antibody, ADA) of 493-004 was also evaluated. The study design is summarized in Table 37.

TABLE 37

Dosage, Volume, Concentration, and Route of 493-004 Administered in Rat Toxicology Study

| Group/ | WBP2495 (RBT-0813 DS) Doses[a] | | | | Numbering of Animals | | | |
|---|---|---|---|---|---|---|---|---|
| | Dose | Volume | Conc. | | Dosing Phase | | Recovery | |
| Color | (mg/kg/dose) | (mL/kg) | (mg/mL) | Route | M | F | M | F |
| 1/White | 0 | 20 | 0 | IV | 1001-1010 | 1501-1510 | 1011-1015 | 1511-1515 |
| 2/Green | 30 | 20 | 1.5 | IV | 2001-2010 | 2501-2510 | 2011-2015 | 2511-2515 |
| 3/Yellow | 100 | 20 | 5 | IV | 3001-3010 | 3501-3510 | 3011-3015 | 3511-3515 |
| 4/red | 300 | 20 | 15 | IV | 4001-4010 | 4501-4510 | 4011-4015 | 4511-4515 |
| 5/Cyan | 0 | 10 | 0 | SC | 5001-5010 | 5501-5510 | 5011-5015 | 5511-5515 |
| 6/Magenta | 30 | 10 | 3 | SC | 6001-6010 | 6501-6510 | 6011-6015 | 6511-6515 |
| 7/Blue | 100 | 10 | 10 | SC | 7001-7010 | 7501-7510 | 7011-7015 | 7511-7515 |

TABLE 37-continued

Dosage, Volume, Concentration, and Route of 493-004 Administered in Rat Toxicology Study

| Group/ Color | WBP2495 (RBT-0813 DS) Doses[a] | | | | Numbering of Animals | | | |
| --- | --- | --- | --- | --- | --- | --- | --- | --- |
| | Dose (mg/kg/dose) | Volume (mL/kg) | Conc. (mg/mL) | Route | Dosing Phase | | Recovery | |
| | | | | | M | F | M | F |
| 8/Dark Grey | 248 | 10 | 24.8 | SC | 8001-8010 | 8501-8510 | 8011-8015 | 8511-8515 |

In this protocol, "dose level" and "dosage" are used interchangeably.
[a]Doses represent active ingredient.
Conc. = Concentration; M = Male; F = Female.

Example 14. Non-GLP Studies of Antibody 493-004

This example is designed as a therapeutic, low-dose, early post-infection treatment study in hamsters infected with the Delta variant of the SARS-CoV-2 virus. The study has six groups of animals including a vehicle control and five treatment groups: single dose VHH antibody 202-03 at 1 and 5 mg/kg antibody administered by intraperitoneal injection, and the bispecific antibody 493-004 at 1 and 5 mg/kg administered by intraperitoneal injection, as well as 5 mg/kg administered nasally (50 μl). Two cohorts for each group of animals are assessed. Cohort A is monitored for weight and health Score for 4 days and terminated on day 4. Viral titer is determined in the lungs and trachea. Cohort B is monitored for weight and health score for 14 days (end of study). There are 5 time points for oral & nasopharyngeal swab and PFU determination in swabs. Additionally, the lungs from Cohort A and B terminal/animals are harvested at the end of the study for histopathology analysis with serum collected from Cohort B at timepoints: pre-challenge, +12 h, +48 h (2D), 72H (3D), +96H (4D), +144H (6D), Day 10, and Day 14.

Based on the data shown in FIG. 38, the bispecific antibody administered at 5 mg/kg by intraperitoneal injection and 1 mg/kg nasally, resulted in improved body weights in the animals starting 4-days after start of the challenge.

Another study is designed as a therapeutic, high-dose, late post-infection treatment study in both immunocompromised and non-immunocompromised Syrian hamsters infected with the Delta variant of the SARS-CoV-2 virus. The study has nine groups of animals including three control and six treatment groups: single dose bispecific antibody 493-004 administered at 10 mg/kg by intraperitoneal injection at days −1, +1, +2, +3, and +4 post-infection.

Based on the data shown in FIG. 39 and FIG. 40, the bispecific antibody appears to demonstrate a therapeutic response and animal weights increased after administration of the antibody on each of the days administered (e.g., day 1, 2, 3, or 4 post-infection).

Example 15. Human Clinical Studies with Antibody 493-004

This experiment described a first-in human combined Phase 1/2a, randomized, placebo-controlled clinical study. FIG. 27A depicts a schematic design of a Phase 1 clinical trial in humans. The seven cohorts in the Phase 1 aspect of the study evaluate the safety and PK of the following doses and routes of administration for the bispecific monoclonal antibody: Cohort 1 is a single intravenous (IV) dose of 0.1 mg/kg anti-S1 mAb (n=3) or matching placebo (n=2); Cohort 2 is a single IV dose of 0.3 mg/kg anti-S1 mAb (n=3) or matching placebo (n=1); Cohort 3 is a single IV dose of 1 mg/kg anti-S1 mAb (n=3) or matching placebo (n=1); Cohort 4 is a single IV dose of 3 mg/kg anti-S1 mAb (n=6) or matching placebo (n=2); Cohort 5 is a single IV dose of 5 mg/kg anti-S1 mAb (n=6) or matching placebo (n=2); Cohort 6 is a single subcutaneous (SC) dose of 5 mg/kg anti-S1 mAb (n=8) or matching placebo (n=2); and Cohort 7 is a single SC dose of 7.5 mg/kg anti-S1 mAb (n=8) or matching placebo (n=2).

FIG. 27B depicts an schematic design of a Phase 2A clinical trial in humans. Dosing in the Phase 2A portion of the study includes only subcutaneous administration of the bispecific monoclonal antibody, in three cohorts: Cohort 1 is a single SC dose of 3 mg/kg anti-S1 mAb (n=30) or matching placebo (n=10); Cohort 2 is a single SC dose of 5 mg/kg anti-S1 mAb (n=30) or matching placebo (n=10); and Cohort 3 is a single SC dose of 7.5 mg/kg anti-S1 mAb (n=30) or matching placebo (n=10).

Example 16. Alanine Mutational Analysis

Alanine mutational analysis of the VHH antibodies 339-031 and 202-03 confirm that the two different VHHs target closely adjacent epitopes that share no critical contacts but are too close to bind simultaneously. Their collectively broader epitope coverage than either one of them individually compensate for one another and likely is responsible for the maintained binding and neutralization capabilities of the 493-004 bispecific against all known SARS-CoV-2 variants of concern (FIG. 44).

The yellow ribbon represents the RBD of a single spike protein from the SARS-CoV-2 virus; red modalities represent the critical contact points for the parent VHH antibody 202-03, and the specific amino acids are identified by their code and location; green modalities represent the critical contact points for the parent VHH antibody 339-031, and the specific amino acids are identified by their code and location.

Coupling together dual specificity and multi-valency gives the construct 493-004 a unique benefit over the use of traditional IgGs. Due to traditional IgG targeting of more than one specificity, the clinical therapeutic effects of bispecific antibodies are considered superior to those of monotherapies. Additionally, the construct's quadrivalent design allows for avidity-boosting effects beyond that of a traditional bivalent IgG format, such that binding is still retained even if one or both binding specificities reduce affinity for their target, in the context of an evolving mutational landscape for SARS-CoV-2. There are also significant structural differences between 493-004 and therapeutic IgG antibodies that may lead to not only acute advantages in neutralization but may also provide a cellular response and longevity of protection through the human IgG1 Fc effector function which is the scaffold to which the VHH antibodies of 493-004 are connected. It is plausible that a bispecific antibody constructs such as 493-004 may demonstrate greater resistance to ongoing mutational challenges from the SARS-CoV-2 virus and have greater longevity and offer a clinically meaningful therapeutic treatment for patients with COVID-19.

The assays are a triplicate 3-fold dilution series of the 493-004 antibody starting with 12,346 ng/mL and ending with 0.209 ng/mL (versus the initial series that assessed a range of 500,000 ng/mL to 2.8 ng/mL) to provide both greater definition and precision of the dose-response curves, as well as antibody concentrations exhibiting both 100% and 0% inhibition. The assays are for all three Omicron variant lineages BA.1, BA.2, and BA.3, as well as include the ancestral SARS-CoV-2 virus as a reference (preliminary results shown in FIG. 45). Calculations of the EC50 and EC90 values will also be determined for 493-004 against all three lineages.

Example 17. Cell Line Development

The Chinese Hamster Ovary (CHO) K1 cell line was used for generation of the 493-004 stable cell line. Expression plasmids were transfected into the CHO-K1 host cell line by electroporation. The transfected pools were cultured with selection pressure for two weeks. After pool recovery, the pools were used for cloning.

One round of fluorescence-activated cell sorting (FACS) couples with single cell imaging was used as the cloning method to obtain the production clonal cell line. From this, thirty clones were isolated and screened further in feed batch cultured in spin tubes, with fifteen clones emerging as promising. The highest clone titer from the fed-batch was 5.75 grams/Liter. Based on titer and growth profile, the top fifteen clones were selected for Size Exclusion Chromatography (SEC) analysis.

These top fifteen clones were subjected to fed-batch inoculation at a level of 0.4×106 cells/mL and feeding was in the range of 0-3% on days 3, 5, 7, 9, 11 and 14. Based on titer and SEC results, the top ten clones were selected for product quality attributes testing (clonality image quality, growth, and metabolic profiles and SEC-UPLC) and Ambr250 evaluation (FIG. 46A).

Clone screening was done by culturing each of the top ten clones in an Ambr250 bioreactor using a traditional fed batch process for screening and evaluation. Out of this, normally the top five clones are chosen for process optimization. Each top five clone is cultured 3× in Ambr250 specifically designed to reduce high molecular weight (HMW) species and separately in a 3 L bioreactor to evaluate process comparability between the 3 L bioreactor and Ambr250. The final clone is then chosen from this evaluation and produced also via traditional fed batch process in a 15 L bioreactor for process lock to mimic the future GMP run at 500 L being used to produce materials for clinical trials.

Evaluations for the clonal stages were as follows. The top five clones were selected based on cell culture, productivity and quality results of CLD spin tube study. The top two were selected based on cell culture, productivity and quality results of the Ambr250 clone screening. In addition, genetic stability was performed on these clones. For the final clone, the top priority was low levels of HMW species, with secondary criteria of promising productivity and good quality attributes.

Upon review of cell culture profiles of the top ten clones, the following attributes were evaluated: viable cell density over time, viability over time, lactate (g/mL) over time, and titer over time (starting at Day 10). From the top ten clones, clones 2495A-01-12 and 2495A-01-14 revealed lower lactate consumption rate compared to the other top clones. Clones 2495A-01-12 and 2495A-02-14 were ruled out as they showed insufficient productivity; all other clones reached promising productivity of greater than 4.0 g/L on harvest day.

When these five top clones were further subjected to quality parameter analysis as per the table above (FIG. 46C), only two clones proved suitable to take forward for screening: BV16-2495A-01-08 and BV21-2495A-02-08. These clones showed all-around performance in all categories, including favorable comparability to the 200 L batch generated for toxicology studies (FIG. 46B).

To make the final clone selection, the top two clones were each sub-cultured four times across two rounds of testing in Ambr250 and a 3 L bioreactor, varying temperatures, initial seed density and feeding schemes to optimize clonal performance. The clones were studied in the production medium and monitored for viability percentage. Key parameters evaluated included viable cell density (106 cells/mL) over time, viability (%) over time, lactate amount (g/L) over time and titer (g/L) over time (FIG. 46C). Clone 2495A-01-08 was chosen for creation of the Master Cell Bank (MCB).

Example 17. CyroEM Studies

In this experiment, CryoEM structure determination and epitope mapping was performed for SARS-CoV-2 S protein ectodomain in complex with bispecific antibody 493-004.

To prepare the target sample for analysis, 24 mg of lyophilized powder was dissolved in 260 µl of MilliQ water. After resting for 30 minutes at room temperature, the solution was transferred into a 200 µl dialysis button and covered by a dialysis membrane with 14 kDa cutoff. The solution was dialyzed at 4° C. overnight (17 hours) into PBS, pH 7.4 to remove the trehalose. To measure the concentration, the solution was transferred into an eppendorf tube and measured using NanoDrop with PBS as a reference. The solution was then immediately used for grid preparation.

To prepare the ligand for analysis, a stock solution stored at −80° C. was slowly thawed on ice and diluted sequentially first 7× into PBS pH 7.4, followed by 4.5× or 6× dilution also into PBS. 1 ul of either of these two diluted solutions was then used to prepare the spike/bsAb complex. A new aliquot was thawed before each preparation so that every sample used experienced at most one freeze/thaw cycle.

A cryogenic sample grid was made by taking the prepared spike target and bispecificAb solutions and mixing them to obtain a bispecificAb monomer to spike trimer ratio of 3:1 or 2:1, which was achieved by mixing 1 uL of bispecificAb solution with 9 uL of the spike solution. The mixed solution was incubated for 15 minutes at 4° C. and immediately vitrified in liquid ethane (FIG. 49).

Data collection was performed using a Titan Krios XFEG, 300 kV, Cs 2.7 mm, Gatan K3 DED microscope and movie properties were set at 5760×4092, 0.83 Å/pixel, 40 frames, 1.1 e/Å²/frame. Collection mode was set to non-super resolution counting mode; compensated fringe free imaging in 3×3 or 5×5 beam shift pattern with 3 expositions per hole using custom serial EM scripts. The defocus range as −0.65 to −2.6 um.

Collected movies were subjected to a motion search algorithm and both motion-corrected and motion-corrected and dose-weighted micrographs were produced. Motion corrected-micrographs without dose-weighting were used for defocus estimation, while motion-corrected and dose-weighted micrographs were used for further processing (FIG. 50).

Particle picking was performed on denoised micrographs using deep learning-based approaches, selecting slightly over 7 M potential particles. These potential particles were split into 71 sets of about 100 k particles each and each set was subjected to a "cleaning" 3D classification against a spike-only (i.e. without antibody) initial model created earlier in the screening phase of the project, leaving about 1.4 M particles showing clear antibody density. These particles were then split into 6 sets, each about 233 k particles and each set was further subjected to two rounds of 2D classification (one standard, one suppressing low frequency CTF correction) to create a clean set of 588 k particles. A first unmasked consensus refinement was performed on this set, yielding a 3.5 Å map of the spike with strong densities for VHH in position 1 (VHH1) and VHH in position 2 (VHH2) and weak density for VHH in position 3 (VHH3). Following this initial refinement up with Bayesian polishing and per-particle defocus refinement improved the resolution to 3.2 Å. In further text this map is the "initial consensus map" (FIG. 51A).

Using the "initial consensus map", a masked 3D classification to 2 classes with local searches was performed, where the mask encapsulated the locations of VHH1 and VHH2 and their respective RBDs. This classification separated remaining unbound spike particles (class 1) and particles with strong VHH1 and VHH2 densities (class 2). This class 2, containing 348 k particles, was then used for a masked 3D refinement with local searches, producing the 3.4 Å [M4.3] map used to build the majority of the VHH1 epitope/paratope (FIG. 51B). Since the density for VHH2 was still suboptimal, additional masked 3D refinement with local searches was performed but with mask specifically only around VHH2 and its corresponding RBD up location. This refinement produced the 3.3 Å [M4.5] map used to build the VHH2 epitope/paratope (FIG. 51D).

The VHH3 was clearly visible in the "initial consensus map" but too weak to interpret correctly. Thus the "initial consensus map" was used as a basis for no-align 3D classification to 6 classes. This 3D classification revealed 4 classes that represented either unbound, all RBD down spike or spike with very weak density at VHH position 3 and 2 classes with a stronger density around the VHH position 3. These 2 classes, comprising 274 k particles, were then combined and subjected to an unmasked 3D refinement that yielded the 3.3 Å [M4.1] map referred to as the "global consensus map". Upon convergence, however, the density for the VHH3, was already misaligned due to the presence of the spike body. Indeed, 3.3 Å represents the resolution of the spike body, not the true resolution of the VHH3 part of the map. Most reliable fitting of the VHH3 density could be done using map from iteration 8 of this global consensus refinement, which yielded the 6 Å [M4.2] map used to assign the position of VHH3. Further attempts at improving the density of VHH3 using similar approaches as those used for VHH1 and VHH2 did not bring any improvement. The most likely reason being that while VHH1 and VHH2 are rigidly bound to their respective RBD domains, VHH3 appears to be only flexibly bound to its RBD domain and the mass of VHH3 itself is too small to refine properly on its own.

Finally, the "global consensus map" was used as a basis for multi-body refinement that encapsulated VHH1 and parts of its surrounding RBD domain and especially the N-term domain of the neighboring B chain as one body (with spike core being the second body). This multi-body refinement yielded the 3.7 Å [M4.4] map that resolved the N-term interface well and which was used to build the N-term B chain epitope of VHH in position 1 (FIG. 51C).

Initially, pdb:6x2b was used to rigid-body fit the map densities. Afterwards, all relevant residues were manually remodeled to correspond to the map density. The sequence of 6×2b was corrected to include all the amino acids present in the spike construct, which also aligned it such that the amino acids numbers correspond to the provided mutagenesis numbering. The model building then proceeded iteratively combining restrained molecular dynamics with manual intervention to build stereochemically valid models with best possible correspondence to the density.

A similar approach was adopted for building the VHH models, only here AlphaFold2 predictions of the N-term and C-term VHH domains of the bispecific construct were used as a starting point for the rigid body fitting and subsequent manual/molecular dynamics remodeling.

The structure reconstruction revealed densities for three out of the four VHHs present on the bispecific antibody, as well as a density corresponding to the constant fragment. The location or presence of the fourth VHH could not be confirmed (FIGS. 52A-52D).

Two of the revealed VHHs were confirmed to be the N-terminal VHHs and are bound to RBD down (position 1) and an RBD up domain (position 2). Identity of the third one could not be confirmed directly but stoichiometry of the bispecific antibody, connection with the constant fragment, and expected binding site all suggest it is the C-terminal VHH of the same bispecific antibody (FIGS. 52A-52D).

The two N-terminal VHHs are bound to RBDs in different positions. Their epitopes do overlap to a large extent but are not completely identical. Specifically (but not only) VHH in position 1 also interacts with neighboring chain B via the chain's N-terminal domain. This interaction is not present in VHH in position 2 epitope and the epitope in position 2 is limited solely to the respective RBD on chain B. The small change in the epitope/paratope between position 1 and 2 also suggests that the N-term VHH tolerates change/loss of several of its interface residues without losing capacity to bind (FIGS. 52A-52D).

The epitope of the third VHH bound to the second RBD up domain could not be determined in detail but the general position of the VHH with respect to the RBD suggests it is different from VHH1 and VHH2.

To determine the interacting epitope/paratope, three complementary strategies were used. In one strategy, the neighboring spike/VHH residues were manually inspected during model building; in the second approach residues were automatically verified using computational methods, which analyze residue interfacing based on solvent-accessible area, buried surface area, and solvation energy; and in the third one, residues were taken simply within 5 Å distance. The first two methods were used interchangeably, i.e. automatically determined residues were manually inspected for further undetected interactions and vice versa, manual residues were compared to the automatic list and if not present there, they were further examined in detail to confirm the interaction.

Additional results of the CryoEM experiments can be found in FIGS. 53-62.

While preferred embodiments of the present disclosure have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the disclosure described herein may be employed in practicing the disclosure. It is intended that the following claims define the scope of the disclosure and that methods and structures within the scope of these claims and their equivalents be covered thereby.

SEQUENCE LISTING (2679 sequences)

SEQ ID NO: 1 - protein, 9 aa, Artificial Sequence
  Description of Artificial Sequence: Synthetic peptide
RTFSDDTMG

SEQ ID NO: 2 - protein, 9 aa, Artificial Sequence
  Description of Artificial Sequence: Synthetic peptide
RTFGDYIMG

SEQ ID NO: 3 - protein, 9 aa, Artificial Sequence
  Description of Artificial Sequence: Synthetic peptide
RTFSDDAMG

SEQ ID NO: 4 - protein, 9 aa, Artificial Sequence
  Description of Artificial Sequence: Synthetic peptide
RTFGDYIMG

SEQ ID NO: 5 - protein, 9 aa, Artificial Sequence
  Description of Artificial Sequence: Synthetic peptide
RTFGDDTMG

SEQ ID NO: 6 - protein, 9 aa, Artificial Sequence
  Description of Artificial Sequence: Synthetic peptide
RTFGDDTMG

SEQ ID NO: 7 - protein, 9 aa, Artificial Sequence
  Description of Artificial Sequence: Synthetic peptide
RTFGDYIMG

SEQ ID NO: 8 - protein, 9 aa, Artificial Sequence
  Description of Artificial Sequence: Synthetic peptide
RTFGDYIMG

SEQ ID NO: 9 - protein, 9 aa, Artificial Sequence
  Description of Artificial Sequence: Synthetic peptide
RTFGDYIMG

SEQ ID NO: 10 - protein, 9 aa, Artificial Sequence
  Description of Artificial Sequence: Synthetic peptide
RTFSDDTMG

SEQ ID NO: 11 - protein, 9 aa, Artificial Sequence
  Description of Artificial Sequence: Synthetic peptide
RTFGDYAMG

SEQ ID NO: 12 - protein, 9 aa, Artificial Sequence
  Description of Artificial Sequence: Synthetic peptide
RTFGDDTMG

SEQ ID NO: 13 - protein, 9 aa, Artificial Sequence
  Description of Artificial Sequence: Synthetic peptide
RTFGDDTMG

SEQ ID NO: 14 - protein, 9 aa, Artificial Sequence
  Description of Artificial Sequence: Synthetic peptide
RTFSDDTMG

SEQ ID NO: 15 - protein, 9 aa, Artificial Sequence
  Description of Artificial Sequence: Synthetic peptide
RTFSDDTMG

SEQ ID NO: 16 - protein, 9 aa, Artificial Sequence
  Description of Artificial Sequence: Synthetic peptide
RTFSDYTMG

SEQ ID NO: 17 - protein, 9 aa, Artificial Sequence
  Description of Artificial Sequence: Synthetic peptide
RTFGDDTMG

SEQ ID NO: 18 - protein, 9 aa, Artificial Sequence
  Description of Artificial Sequence: Synthetic peptide
RTFGDYIMG

SEQ ID NO: 19 - protein, 9 aa, Artificial Sequence
  Description of Artificial Sequence: Synthetic peptide
RTFSDDTMG

SEQ ID NO: 20 - protein, 9 aa, Artificial Sequence
  Description of Artificial Sequence: Synthetic peptide
RTFGDDIMG

SEQ ID NO: 21 - protein, 9 aa, Artificial Sequence
  Description of Artificial Sequence: Synthetic peptide
RTFSDDTMG

SEQ ID NO: 22 - protein, 9 aa, Artificial Sequence
  Description of Artificial Sequence: Synthetic peptide
RTFGDYIMG

SEQ ID NO: 23 - protein, 9 aa, Artificial Sequence
  Description of Artificial Sequence: Synthetic peptide
RTFSDDAMG

SEQ ID NO: 24 - protein, 9 aa, Artificial Sequence
  Description of Artificial Sequence: Synthetic peptide
RTFSDYTMG

SEQ ID NO: 25 - protein, 9 aa, Artificial Sequence
  Description of Artificial Sequence: Synthetic peptide
GTFSRYAMG

SEQ ID NO: 26 - protein, 9 aa, Artificial Sequence
  Description of Artificial Sequence: Synthetic peptide
RTFSDDTMG

SEQ ID NO: 27 - protein, 9 aa, Artificial Sequence
  Description of Artificial Sequence: Synthetic peptide
RTFGDYIMG

SEQ ID NO: 28 - protein, 9 aa, Artificial Sequence
  Description of Artificial Sequence: Synthetic peptide
RTFGDDTMG

SEQ ID NO: 29 - protein, 9 aa, Artificial Sequence
  Description of Artificial Sequence: Synthetic peptide
RTFGDDTMG

SEQ ID NO: 30 - protein, 9 aa, Artificial Sequence
  Description of Artificial Sequence: Synthetic peptide
RTFGDYTMG

SEQ ID NO: 31 - protein, 9 aa, Artificial Sequence
  Description of Artificial Sequence: Synthetic peptide
RTFGDYIMG

SEQ ID NO: 32 - protein, 9 aa, Artificial Sequence
  Description of Artificial Sequence: Synthetic peptide
FTFDDYEMG

SEQ ID NO: 33 - protein, 9 aa, Artificial Sequence
  Description of Artificial Sequence: Synthetic peptide
FTFSRHDMG

SEQ ID NO: 34 - protein, 9 aa, Artificial Sequence
  Description of Artificial Sequence: Synthetic peptide
RTFGDYIMG

SEQ ID NO: 35 - protein, 11 aa, Artificial Sequence
  Description of Artificial Sequence: Synthetic peptide
QLANFASYAMG

SEQ ID NO: 36 - protein, 9 aa, Artificial Sequence
  Description of Artificial Sequence: Synthetic peptide
RTFGDYIMG

SEQ ID NO: 37 - protein, 9 aa, Artificial Sequence
  Description of Artificial Sequence: Synthetic peptide
RTFGDYGMG

SEQ ID NO: 38 - protein, 9 aa, Artificial Sequence
  Description of Artificial Sequence: Synthetic peptide
RTFSDDTMG

SEQ ID NO: 39 - protein, 9 aa, Artificial Sequence
  Description of Artificial Sequence: Synthetic peptide
RTFSNAAMG

SEQ ID NO: 40 - protein, 9 aa, Artificial Sequence
  Description of Artificial Sequence: Synthetic peptide
RTFSDDTMG

SEQ ID NO: 41 - protein, 9 aa, Artificial Sequence
  Description of Artificial Sequence: Synthetic peptide
RTFGDYIMG

SEQ ID NO: 42 - protein, 9 aa, Artificial Sequence
  Description of Artificial Sequence: Synthetic peptide
RTFGDDTMG

SEQ ID NO: 43 - protein, 9 aa, Artificial Sequence
  Description of Artificial Sequence: Synthetic peptide
RTFSDDTMG

SEQ ID NO: 44 - protein, 9 aa, Artificial Sequence
  Description of Artificial Sequence: Synthetic peptide
RTFGDYIMG

SEQ ID NO: 45 - protein, 9 aa, Artificial Sequence
  Description of Artificial Sequence: Synthetic peptide
RTFSDDAMG

SEQ ID NO: 46 - protein, 9 aa, Artificial Sequence
  Description of Artificial Sequence: Synthetic peptide
RTFGDYIMG

SEQ ID NO: 47 - protein, 9 aa, Artificial Sequence
  Description of Artificial Sequence: Synthetic peptide
FTFGDYVMG

SEQ ID NO: 48 - protein, 9 aa, Artificial Sequence
  Description of Artificial Sequence: Synthetic peptide
RTFSDDAMG

SEQ ID NO: 49 - protein, 9 aa, Artificial Sequence
  Description of Artificial Sequence: Synthetic peptide
RTFGDYIMG

SEQ ID NO: 50 - protein, 9 aa, Artificial Sequence
  Description of Artificial Sequence: Synthetic peptide
GTFSNSGMG

SEQ ID NO: 51 - protein, 13 aa, Artificial Sequence
  Description of Artificial Sequence: Synthetic peptide
GGISWSGGNTYYA

SEQ ID NO: 52 - protein, 13 aa, Artificial Sequence
  Description of Artificial Sequence: Synthetic peptide
AAINWSAGYTAYA

SEQ ID NO: 53 - protein, 13 aa, Artificial Sequence
  Description of Artificial Sequence: Synthetic peptide
AAINWSGGTTRYA

SEQ ID NO: 54 - protein, 13 aa, Artificial Sequence
  Description of Artificial Sequence: Synthetic peptide
AAINWIAGYTADA

SEQ ID NO: 55 - protein, 13 aa, Artificial Sequence
  Description of Artificial Sequence: Synthetic peptide
AAINWSGGNTYYA

SEQ ID NO: 56 - protein, 13 aa, Artificial Sequence
  Description of Artificial Sequence: Synthetic peptide
AAINWTGGYTPYA

SEQ ID NO: 57 - protein, 13 aa, Artificial Sequence
  Description of Artificial Sequence: Synthetic peptide
AAINWSGGYTAYA

SEQ ID NO: 58 - protein, 13 aa, Artificial Sequence
  Description of Artificial Sequence: Synthetic peptide
GGINWSGGYTYYA

SEQ ID NO: 59 - protein, 13 aa, Artificial Sequence
  Description of Artificial Sequence: Synthetic peptide
AAINWSGGYTHYA

SEQ ID NO: 60 - protein, 13 aa, Artificial Sequence
  Description of Artificial Sequence: Synthetic peptide
AAIHWSGSSTRYA

SEQ ID NO: 61 - protein, 13 aa, Artificial Sequence
  Description of Artificial Sequence: Synthetic peptide
APINWSGGSTYYA

SEQ ID NO: 62 - protein, 13 aa, Artificial Sequence
  Description of Artificial Sequence: Synthetic peptide
AAINWSGGNTPYA

SEQ ID NO: 63 - protein, 13 aa, Artificial Sequence
  Description of Artificial Sequence: Synthetic peptide
AAINWSGDNTHYA

SEQ ID NO: 64 - protein, 13 aa, Artificial Sequence
  Description of Artificial Sequence: Synthetic peptide
AAINWSGGTTRYA

SEQ ID NO: 65 - protein, 13 aa, Artificial Sequence
  Description of Artificial Sequence: Synthetic peptide
AAINWSGDSTYYA

SEQ ID NO: 66 - protein, 13 aa, Artificial Sequence
  Description of Artificial Sequence: Synthetic peptide
AAINWSGGYTYYA

SEQ ID NO: 67 - protein, 13 aa, Artificial Sequence
  Description of Artificial Sequence: Synthetic peptide
AAINWSGGNTDYA

SEQ ID NO: 68 - protein, 13 aa, Artificial Sequence
  Description of Artificial Sequence: Synthetic peptide
AAINWSGGYTPYA

SEQ ID NO: 69 - protein, 13 aa, Artificial Sequence
  Description of Artificial Sequence: Synthetic peptide
AAINWSGGSTYYA

SEQ ID NO: 70 - protein, 13 aa, Artificial Sequence
  Description of Artificial Sequence: Synthetic peptide
AAIHWSAGYTRYA

SEQ ID NO: 71 - protein, 13 aa, Artificial Sequence
  Description of Artificial Sequence: Synthetic peptide
AGMTWSGSSTFYA

SEQ ID NO: 72 - protein, 13 aa, Artificial Sequence
  Description of Artificial Sequence: Synthetic peptide
AAINWSGDNTHYA

SEQ ID NO: 73 - protein, 13 aa, Artificial Sequence
  Description of Artificial Sequence: Synthetic peptide
AGISWNGGSIYYA

SEQ ID NO: 74 - protein, 13 aa, Artificial Sequence
  Description of Artificial Sequence: Synthetic peptide
AAINWSGGTTYYA

SEQ ID NO: 75 - protein, 12 aa, Artificial Sequence
  Description of Artificial Sequence: Synthetic peptide
SAVDSGGSTYYA

SEQ ID NO: 76 - protein, 13 aa, Artificial Sequence
  Description of Artificial Sequence: Synthetic peptide
AAVNWSGGSTYYA

SEQ ID NO: 77 - protein, 13 aa, Artificial Sequence
  Description of Artificial Sequence: Synthetic peptide
AAINWSAGYTAYA

SEQ ID NO: 78 - protein, 13 aa, Artificial Sequence
  Description of Artificial Sequence: Synthetic peptide
AAINWNGGNTHYA

SEQ ID NO: 79 - protein, 13 aa, Artificial Sequence
  Description of Artificial Sequence: Synthetic peptide
AAINWSGGYTYYA

SEQ ID NO: 80 - protein, 13 aa, Artificial Sequence
  Description of Artificial Sequence: Synthetic peptide
AAINWTGGYTYYA

SEQ ID NO: 81 - protein, 13 aa, Artificial Sequence
  Description of Artificial Sequence: Synthetic peptide
AAINWSAGYTAYA

SEQ ID NO: 82 - protein, 13 aa, Artificial Sequence
  Description of Artificial Sequence: Synthetic peptide
AAISWRGGTTYYA

SEQ ID NO: 83 - protein, 13 aa, Artificial Sequence
  Description of Artificial Sequence: Synthetic peptide
AGINWESGSTNYA

SEQ ID NO: 84 - protein, 13 aa, Artificial Sequence
  Description of Artificial Sequence: Synthetic peptide
AAINWSADYTAYA

SEQ ID NO: 85 - protein, 13 aa, Artificial Sequence
  Description of Artificial Sequence: Synthetic peptide
AAITRSGSSTVYA

SEQ ID NO: 86 - protein, 13 aa, Artificial Sequence
  Description of Artificial Sequence: Synthetic peptide
AAINWSAGYTAYA

SEQ ID NO: 87 - protein, 13 aa, Artificial Sequence
  Description of Artificial Sequence: Synthetic peptide
ATINWSGALTHYA

SEQ ID NO: 88 - protein, 13 aa, Artificial Sequence
  Description of Artificial Sequence: Synthetic peptide
AAITWSGGRTRYA

SEQ ID NO: 89 - protein, 13 aa, Artificial Sequence
  Description of Artificial Sequence: Synthetic peptide
ARILWTGASRNYA

SEQ ID NO: 90 - protein, 13 aa, Artificial Sequence
  Description of Artificial Sequence: Synthetic peptide
AGINWSGNGVYYA

SEQ ID NO: 91 - protein, 13 aa, Artificial Sequence
  Description of Artificial Sequence: Synthetic peptide
AAINWSGGTTPYA

SEQ ID NO: 92 - protein, 13 aa, Artificial Sequence
  Description of Artificial Sequence: Synthetic peptide
AAINWSGGYTPYA

SEQ ID NO: 93 - protein, 13 aa, Artificial Sequence
  Description of Artificial Sequence: Synthetic peptide
AAINWSGGSTDYA

SEQ ID NO: 94 - protein, 13 aa, Artificial Sequence
  Description of Artificial Sequence: Synthetic peptide
AAINWSAGYTAYA

SEQ ID NO: 95 - protein, 13 aa, Artificial Sequence
  Description of Artificial Sequence: Synthetic peptide
AAINWSGGSTRYA

SEQ ID NO: 96 - protein, 13 aa, Artificial Sequence
  Description of Artificial Sequence: Synthetic peptide
AAINWSAGYTPYA

SEQ ID NO: 97 - protein, 13 aa, Artificial Sequence
  Description of Artificial Sequence: Synthetic peptide
AAINWNAGYTAYA

SEQ ID NO: 98 - protein, 13 aa, Artificial Sequence
  Description of Artificial Sequence: Synthetic peptide
GRINWSGGNTYYA

SEQ ID NO: 99 - protein, 13 aa, Artificial Sequence
  Description of Artificial Sequence: Synthetic peptide
AAINWSAGYTAYA

SEQ ID NO: 100 - protein, 13 aa, Artificial Sequence
  Description of Artificial Sequence: Synthetic peptide
AVVNWSGRRTYYA

SEQ ID NO: 101 - protein, 9 aa, Artificial Sequence
  Description of Artificial Sequence: Synthetic peptide
CATDPPLFW

SEQ ID NO: 102 - protein, 15 aa, Artificial Sequence
  Description of Artificial Sequence: Synthetic peptide
CARASPNTGWHFDRW

SEQ ID NO: 103 - protein, 9 aa, Artificial Sequence
  Description of Artificial Sequence: Synthetic peptide
CATDPPLFW

SEQ ID NO: 104 - protein, 15 aa, Artificial Sequence
  Description of Artificial Sequence: Synthetic peptide
CAEPSPNTGWHFDHW

SEQ ID NO: 105 - protein, 9 aa, Artificial Sequence
  Description of Artificial Sequence: Synthetic peptide
CATDPPLFW

SEQ ID NO: 106 - protein, 9 aa, Artificial Sequence
  Description of Artificial Sequence: Synthetic peptide
CATDPPLFW

SEQ ID NO: 107 - protein, 15 aa, Artificial Sequence
  Description of Artificial Sequence: Synthetic peptide
CATASPNTGWHFDHW

SEQ ID NO: 108 - protein, 9 aa, Artificial Sequence
  Description of Artificial Sequence: Synthetic peptide
CATDPPLFW

SEQ ID NO: 109 - protein, 9 aa, Artificial Sequence
  Description of Artificial Sequence: Synthetic peptide
CATDPPLFW

SEQ ID NO: 110 - protein, 9 aa, Artificial Sequence
  Description of Artificial Sequence: Synthetic peptide
CATDPPLFW

SEQ ID NO: 111 - protein, 9 aa, Artificial Sequence
  Description of Artificial Sequence: Synthetic peptide
CATDPPLFW

SEQ ID NO: 112 - protein, 9 aa, Artificial Sequence
  Description of Artificial Sequence: Synthetic peptide
CATDPPLFW

SEQ ID NO: 113 - protein, 9 aa, Artificial Sequence
  Description of Artificial Sequence: Synthetic peptide
CATDPPLFW

SEQ ID NO: 114 - protein, 9 aa, Artificial Sequence
  Description of Artificial Sequence: Synthetic peptide
CATDPPLFW

SEQ ID NO: 115 - protein, 9 aa, Artificial Sequence
  Description of Artificial Sequence: Synthetic peptide
CATDPPLFW

SEQ ID NO: 116 - protein, 9 aa, Artificial Sequence
  Description of Artificial Sequence: Synthetic peptide
CATDPPLFW

SEQ ID NO: 117 - protein, 9 aa, Artificial Sequence
  Description of Artificial Sequence: Synthetic peptide
CATDPPLFW

SEQ ID NO: 118 - protein, 9 aa, Artificial Sequence
  Description of Artificial Sequence: Synthetic peptide
CATDPPLFW

SEQ ID NO: 119 - protein, 9 aa, Artificial Sequence
  Description of Artificial Sequence: Synthetic peptide
CATDPPLFW

SEQ ID NO: 120 - protein, 15 aa, Artificial Sequence
  Description of Artificial Sequence: Synthetic peptide
CATDPPLFWGHVDLW

SEQ ID NO: 121 - protein, 9 aa, Artificial Sequence
  Description of Artificial Sequence: Synthetic peptide
CATDPPLFW

SEQ ID NO: 122 - protein, 9 aa, Artificial Sequence
  Description of Artificial Sequence: Synthetic peptide
CATDPPLFW

SEQ ID NO: 123 - protein, 9 aa, Artificial Sequence
  Description of Artificial Sequence: Synthetic peptide
CATDPPLFW

SEQ ID NO: 124 - protein, 9 aa, Artificial Sequence
  Description of Artificial Sequence: Synthetic peptide
CATDPPLFW

SEQ ID NO: 125 - protein, 13 aa, Artificial Sequence
  Description of Artificial Sequence: Synthetic peptide
CAASPSLRSAWQW

SEQ ID NO: 126 - protein, 9 aa, Artificial Sequence
  Description of Artificial Sequence: Synthetic peptide
CATDPPLFW

SEQ ID NO: 127 - protein, 15 aa, Artificial Sequence
  Description of Artificial Sequence: Synthetic peptide
CARATPNTGWHFDHW

SEQ ID NO: 128 - protein, 9 aa, Artificial Sequence
  Description of Artificial Sequence: Synthetic peptide
CATDPPLFW

SEQ ID NO: 129 - protein, 9 aa, Artificial Sequence
  Description of Artificial Sequence: Synthetic peptide
CATDPPLFW

SEQ ID NO: 130 - protein, 9 aa, Artificial Sequence
  Description of Artificial Sequence: Synthetic peptide
CATDPPLFW

SEQ ID NO: 131 - protein, 15 aa, Artificial Sequence
  Description of Artificial Sequence: Synthetic peptide
CATASPNTGWHFDHW

SEQ ID NO: 132 - protein, 18 aa, Artificial Sequence
  Description of Artificial Sequence: Synthetic peptide
CAADRRGLASTRAGDYDW

SEQ ID NO: 133 - protein, 20 aa, Artificial Sequence
  Description of Artificial Sequence: Synthetic peptide
CAADRGVYGGRWYRTSQYTW

SEQ ID NO: 134 - protein, 15 aa, Artificial Sequence
  Description of Artificial Sequence: Synthetic peptide
CATDPPLFCWHFDHW

SEQ ID NO: 135 - protein, 11 aa, Artificial Sequence
  Description of Artificial Sequence: Synthetic peptide
CATTMNPNPRW

SEQ ID NO: 136 - protein, 15 aa, Artificial Sequence
  Description of Artificial Sequence: Synthetic peptide
CATAPPLFCWHFDHW

SEQ ID NO: 137 - protein, 23 aa, Artificial Sequence
  Description of Artificial Sequence: Synthetic peptide
CATLPFYDFWSGYYTGYYYMDVW

SEQ ID NO: 138 - protein, 9 aa, Artificial Sequence
  Description of Artificial Sequence: Synthetic peptide
CATDRPLFW

SEQ ID NO: 139 - protein, 11 aa, Artificial Sequence
  Description of Artificial Sequence: Synthetic peptide
CATTENPNPRW

SEQ ID NO: 140 - protein, 9 aa, Artificial Sequence
  Description of Artificial Sequence: Synthetic peptide
CATDPPLFW

SEQ ID NO: 141 - protein, 15 aa, Artificial Sequence
  Description of Artificial Sequence: Synthetic peptide
CATDPPLFCCHVDLW

SEQ ID NO: 142 - protein, 15 aa, Artificial Sequence
  Description of Artificial Sequence: Synthetic peptide
CATDPPLFWGHVDLW

SEQ ID NO: 143 - protein, 9 aa, Artificial Sequence
  Description of Artificial Sequence: Synthetic peptide
CATDPPLFW

SEQ ID NO: 144 - protein, 15 aa, Artificial Sequence
  Description of Artificial Sequence: Synthetic peptide
CATARPNTGWHFDHW

SEQ ID NO: 145 - protein, 9 aa, Artificial Sequence
  Description of Artificial Sequence: Synthetic peptide
CATDPPLFW

SEQ ID NO: 146 - protein, 15 aa, Artificial Sequence
  Description of Artificial Sequence: Synthetic peptide
CATDPPLFWGHVDLW

SEQ ID NO: 147 - protein, 15 aa, Artificial Sequence
  Description of Artificial Sequence: Synthetic peptide
CAKASPNTGWHFDHW

SEQ ID NO: 148 - protein, 9 aa, Artificial Sequence
  Description of Artificial Sequence: Synthetic peptide
CATDPPLFW

SEQ ID NO: 149 - protein, 15 aa, Artificial Sequence
  Description of Artificial Sequence: Synthetic peptide
CARASPNTGWHFDHW

SEQ ID NO: 150 - protein, 13 aa, Artificial Sequence
  Description of Artificial Sequence: Synthetic peptide
CAVPWMDYNRRDW

SEQ ID NO: 151 - protein, 9 aa, Artificial Sequence
  Description of Artificial Sequence: Synthetic peptide
FTFSNYATD

SEQ ID NO: 152 - protein, 9 aa, Artificial Sequence
  Description of Artificial Sequence: Synthetic peptide
FTFSRHAMN

SEQ ID NO: 153 - protein, 9 aa, Artificial Sequence
  Description of Artificial Sequence: Synthetic peptide
FTFSDFAMA

SEQ ID NO: 154 - protein, 9 aa, Artificial Sequence
  Description of Artificial Sequence: Synthetic peptide
FTFSDFAMA

SEQ ID NO: 155 - protein, 9 aa, Artificial Sequence
  Description of Artificial Sequence: Synthetic peptide
FTFSDFAMA

SEQ ID NO: 156 - protein, 9 aa, Artificial Sequence
  Description of Artificial Sequence: Synthetic peptide
FTFSDFAMA

SEQ ID NO: 157 - protein, 9 aa, Artificial Sequence
  Description of Artificial Sequence: Synthetic peptide
FTFSDFAMA

SEQ ID NO: 158 - protein, 9 aa, Artificial Sequence
  Description of Artificial Sequence: Synthetic peptide
FTFSDFAMA

SEQ ID NO: 159 - protein, 9 aa, Artificial Sequence
  Description of Artificial Sequence: Synthetic peptide
FTFPRYAMS

SEQ ID NO: 160 - protein, 9 aa, Artificial Sequence
  Description of Artificial Sequence: Synthetic peptide
FTFSAFAMG

SEQ ID NO: 161 - protein, 9 aa, Artificial Sequence
  Description of Artificial Sequence: Synthetic peptide
FTFSNYPMN

SEQ ID NO: 162 - protein, 9 aa, Artificial Sequence
  Description of Artificial Sequence: Synthetic peptide
FTFSDYPMN

SEQ ID NO: 163 - protein, 9 aa, Artificial Sequence
  Description of Artificial Sequence: Synthetic peptide
FTFSDYPMN

SEQ ID NO: 164 - protein, 9 aa, Artificial Sequence
  Description of Artificial Sequence: Synthetic peptide
FTFSDYPMN

SEQ ID NO: 165 - protein, 9 aa, Artificial Sequence
  Description of Artificial Sequence: Synthetic peptide
FTFSDYPMN

SEQ ID NO: 166 - protein, 13 aa, Artificial Sequence
  Description of Artificial Sequence: Synthetic peptide
SIISGSGGATYYA

SEQ ID NO: 167 - protein, 13 aa, Artificial Sequence
  Description of Artificial Sequence: Synthetic peptide
SGISGSGDETYYA

SEQ ID NO: 168 - protein, 13 aa, Artificial Sequence
  Description of Artificial Sequence: Synthetic peptide
SAISGSGDITYYA

SEQ ID NO: 169 - protein, 13 aa, Artificial Sequence
  Description of Artificial Sequence: Synthetic peptide
SAITGTGDITYYA

SEQ ID NO: 170 - protein, 13 aa, Artificial Sequence
  Description of Artificial Sequence: Synthetic peptide
SAISGSGDITYYA

SEQ ID NO: 171 - protein, 13 aa, Artificial Sequence
  Description of Artificial Sequence: Synthetic peptide
SAISGSGDITYYA

SEQ ID NO: 172 - protein, 13 aa, Artificial Sequence
  Description of Artificial Sequence: Synthetic peptide
SAITGSGDITYYA

SEQ ID NO: 173 - protein, 13 aa, Artificial Sequence
  Description of Artificial Sequence: Synthetic peptide
SAISGSGDITYYA

SEQ ID NO: 174 - protein, 13 aa, Artificial Sequence
  Description of Artificial Sequence: Synthetic peptide
STISGSGSTTYYA

SEQ ID NO: 175 - protein, 13 aa, Artificial Sequence
  Description of Artificial Sequence: Synthetic peptide
SAITASGDITYYA

SEQ ID NO: 176 - protein, 13 aa, Artificial Sequence
  Description of Artificial Sequence: Synthetic peptide
STISGSGGNTFYA

SEQ ID NO: 177 - protein, 13 aa, Artificial Sequence
  Description of Artificial Sequence: Synthetic peptide
STISGSGGITFYA

SEQ ID NO: 178 - protein, 13 aa, Artificial Sequence
  Description of Artificial Sequence: Synthetic peptide
SAISGSGDNTYYA

SEQ ID NO: 179 - protein, 13 aa, Artificial Sequence
  Description of Artificial Sequence: Synthetic peptide
SAITGSGDITYYA

SEQ ID NO: 180 - protein, 13 aa, Artificial Sequence
  Description of Artificial Sequence: Synthetic peptide
STISGSGGITFYA

SEQ ID NO: 181 - protein, 21 aa, Artificial Sequence
  Description of Artificial Sequence: Synthetic peptide
CAKGGYCSSDTCWWEYWLDPW

SEQ ID NO: 182 - protein, 24 aa, Artificial Sequence
  Description of Artificial Sequence: Synthetic peptide
CARDLPASYYDSSGYYWHNGMDVW

SEQ ID NO: 183 - protein, 17 aa, Artificial Sequence
  Description of Artificial Sequence: Synthetic peptide
CAREADCLPSPWYLDLW

SEQ ID NO: 184 - protein, 12 aa, Artificial Sequence
  Description of Artificial Sequence: Synthetic peptide
CAREADGLHSPW

SEQ ID NO: 185 - protein, 17 aa, Artificial Sequence
  Description of Artificial Sequence: Synthetic peptide
CAREADGLHSPWHFDLW

SEQ ID NO: 186 - protein, 17 aa, Artificial Sequence
  Description of Artificial Sequence: Synthetic peptide
CAREADGLHSPWHFDLW

SEQ ID NO: 187 - protein, 17 aa, Artificial Sequence
  Description of Artificial Sequence: Synthetic peptide
CAREADGLHSPWHFDLW

SEQ ID NO: 188 - protein, 17 aa, Artificial Sequence
  Description of Artificial Sequence: Synthetic peptide
CAREADGLHSPWHFDLW

SEQ ID NO: 189 - protein, 11 aa, Artificial Sequence
  Description of Artificial Sequence: Synthetic peptide
CARLIDAFDIW

SEQ ID NO: 190 - protein, 17 aa, Artificial Sequence
  Description of Artificial Sequence: Synthetic peptide
CARQSDGLPSPWHFDLG

SEQ ID NO: 191 - protein, 12 aa, Artificial Sequence
  Description of Artificial Sequence: Synthetic peptide
CVRHDEYSFDYW

SEQ ID NO: 192 - protein, 12 aa, Artificial Sequence
  Description of Artificial Sequence: Synthetic peptide
CVRHDEYSFDYW

SEQ ID NO: 193 - protein, 12 aa, Artificial Sequence
  Description of Artificial Sequence: Synthetic peptide
CVRHDEYSFDYW

SEQ ID NO: 194 - protein, 12 aa, Artificial Sequence
  Description of Artificial Sequence: Synthetic peptide
CVRHDEYSFDYW

SEQ ID NO: 195 - protein, 12 aa, Artificial Sequence
  Description of Artificial Sequence: Synthetic peptide
CVRHDEYSFDYW

SEQ ID NO: 196 - protein, 11 aa, Artificial Sequence
  Description of Artificial Sequence: Synthetic peptide
RASQSIHRFLN

SEQ ID NO: 197 - protein, 11 aa, Artificial Sequence
  Description of Artificial Sequence: Synthetic peptide
RASQTINTYLN

SEQ ID NO: 198 - protein, 11 aa, Artificial Sequence
  Description of Artificial Sequence: Synthetic peptide
RASQNIHTYLN

SEQ ID NO: 199 - protein, 11 aa, Artificial Sequence
  Description of Artificial Sequence: Synthetic peptide
RASQSIDTYLN

SEQ ID NO: 200 - protein, 11 aa, Artificial Sequence
  Description of Artificial Sequence: Synthetic peptide
RASQSIHTYLN

SEQ ID NO: 201 - protein, 11 aa, Artificial Sequence
  Description of Artificial Sequence: Synthetic peptide
RASQSIDTYLN

SEQ ID NO: 202 - protein, 11 aa, Artificial Sequence
  Description of Artificial Sequence: Synthetic peptide
RASQSIDTYLN

SEQ ID NO: 203 - protein, 11 aa, Artificial Sequence
  Description of Artificial Sequence: Synthetic peptide
RASQSIDTYLN

SEQ ID NO: 204 - protein, 11 aa, Artificial Sequence
  Description of Artificial Sequence: Synthetic peptide
RASQRIGTYLN

SEQ ID NO: 205 - protein, 11 aa, Artificial Sequence
  Description of Artificial Sequence: Synthetic peptide
RASQSIHISLN

SEQ ID NO: 206 - protein, 11 aa, Artificial Sequence
  Description of Artificial Sequence: Synthetic peptide
RASQSIGNYLN

SEQ ID NO: 207 - protein, 11 aa, Artificial Sequence
  Description of Artificial Sequence: Synthetic peptide
RASQSIDNYLN

SEQ ID NO: 208 - protein, 11 aa, Artificial Sequence
  Description of Artificial Sequence: Synthetic peptide
RASQSIDTYLN

SEQ ID NO: 209 - protein, 11 aa, Artificial Sequence
  Description of Artificial Sequence: Synthetic peptide
RASQSIDTYLN

SEQ ID NO: 210 - protein, 11 aa, Artificial Sequence
  Description of Artificial Sequence: Synthetic peptide
RASQSIDNYLN

SEQ ID NO: 211 - protein, 7 aa, Artificial Sequence
  Description of Artificial Sequence: Synthetic peptide
AASNLHS

SEQ ID NO: 212 - protein, 7 aa, Artificial Sequence
  Description of Artificial Sequence: Synthetic peptide
SASTLQS

SEQ ID NO: 213 - protein, 7 aa, Artificial Sequence
  Description of Artificial Sequence: Synthetic peptide
AASTFAK

SEQ ID NO: 214 - protein, 7 aa, Artificial Sequence
  Description of Artificial Sequence: Synthetic peptide
AASALAS

SEQ ID NO: 215 - protein, 7 aa, Artificial Sequence
  Description of Artificial Sequence: Synthetic peptide
AASALAS

SEQ ID NO: 216 - protein, 7 aa, Artificial Sequence
  Description of Artificial Sequence: Synthetic peptide
AASALAS

SEQ ID NO: 217 - protein, 7 aa, Artificial Sequence
  Description of Artificial Sequence: Synthetic peptide
AASALAS

SEQ ID NO: 218 - protein, 7 aa, Artificial Sequence
  Description of Artificial Sequence: Synthetic peptide
AASALAS

SEQ ID NO: 219 - protein, 7 aa, Artificial Sequence
  Description of Artificial Sequence: Synthetic peptide
AASNLEG

SEQ ID NO: 220 - protein, 7 aa, Artificial Sequence
  Description of Artificial Sequence: Synthetic peptide
LASPLAS

SEQ ID NO: 221 - protein, 7 aa, Artificial Sequence
  Description of Artificial Sequence: Synthetic peptide
GVSSLQS

SEQ ID NO: 222 - protein, 7 aa, Artificial Sequence
  Description of Artificial Sequence: Synthetic peptide
GVSALQS

SEQ ID NO: 223 - protein, 7 aa, Artificial Sequence
  Description of Artificial Sequence: Synthetic peptide
GASALES

SEQ ID NO: 224 - protein, 7 aa, Artificial Sequence
  Description of Artificial Sequence: Synthetic peptide
GVSALQS

SEQ ID NO: 225 - protein, 7 aa, Artificial Sequence
  Description of Artificial Sequence: Synthetic peptide
GVSALQS

SEQ ID NO: 226 - protein, 11 aa, Artificial Sequence
  Description of Artificial Sequence: Synthetic peptide
CQQSYGLPPTF

SEQ ID NO: 227 - protein, 10 aa, Artificial Sequence [sequence omitted]

SEQ ID NO: 228 - protein, 12 aa, Artificial Sequence [sequence omitted]

SEQ ID NO: 229 - protein, 12 aa, Artificial Sequence [sequence omitted]

SEQ ID NO: 230 - protein, 12 aa, Artificial Sequence [sequence omitted]

SEQ ID NO: 231 - protein, 12 aa, Artificial Sequence [sequence omitted]

SEQ ID NO: 232 - protein, 12 aa, Artificial Sequence [sequence omitted]

SEQ ID NO: 233 - protein, 12 aa, Artificial Sequence [sequence omitted]

SEQ ID NO: 234 - protein, 11 aa, Artificial Sequence
  Description of Artificial Sequence: Synthetic peptide
CQQNYSTTWTF

SEQ ID NO: 235 - protein, 12 aa, Artificial Sequence [sequence omitted]

SEQ ID NO: 236 - protein, 11 aa, Artificial Sequence [sequence omitted]

SEQ ID NO: 237 - protein, 12 aa, Artificial Sequence
  Description of Artificial Sequence: Synthetic peptide
CQQSHSAPPYFF

SEQ ID NO: 238 - protein, 12 aa, Artificial Sequence
  Description of Artificial Sequence: Synthetic peptide
CQQSHSAPPYFF

SEQ ID NO: 239 - protein, 12 aa, Artificial Sequence
  Description of Artificial Sequence: Synthetic peptide
CQQSYSAPPYFF

SEQ ID NO: 240 - protein, 11 aa, Artificial Sequence [sequence omitted]

SEQ ID NO: 241 - protein, 9 aa, Artificial Sequence
  Description of Artificial Sequence: Synthetic peptide
FMFGNYAMS

SEQ ID NO: 242 - protein, 9 aa, Artificial Sequence
  Description of Artificial Sequence: Synthetic peptide
FTFRSHAMN

SEQ ID NO: 243 - protein, 9 aa, Artificial Sequence
  Description of Artificial Sequence: Synthetic peptide
FTFRNYAMA

SEQ ID NO: 244 - protein, 9 aa, Artificial Sequence
  Description of Artificial Sequence: Synthetic peptide
FTFRNHAMA

SEQ ID NO: 245 - protein, 9 aa, Artificial Sequence
  Description of Artificial Sequence: Synthetic peptide
FTITNYAMS

SEQ ID NO: 246 - protein, 9 aa, Artificial Sequence
  Description of Artificial Sequence: Synthetic peptide
FTIPNYAMS

SEQ ID NO: 247 - protein, 9 aa, Artificial Sequence
  Description of Artificial Sequence: Synthetic peptide
FTIPNYAMS

SEQ ID NO: 248 - protein, 9 aa, Artificial Sequence
  Description of Artificial Sequence: Synthetic peptide
FTITNYAMS

SEQ ID NO: 249 - protein, 9 aa, Artificial Sequence
  Description of Artificial Sequence: Synthetic peptide
FTITNYAMS

SEQ ID NO: 250 - protein, 9 aa, Artificial Sequence
  Description of Artificial Sequence: Synthetic peptide
FTFRSHAMS

SEQ ID NO: 251 - protein, 9 aa, Artificial Sequence
  Description of Artificial Sequence: Synthetic peptide
FTIRNYAMS

SEQ ID NO: 252 - protein, 9 aa, Artificial Sequence
  Description of Artificial Sequence: Synthetic peptide
FTFRSHAMS

SEQ ID NO: 253 - protein, 9 aa, Artificial Sequence
  Description of Artificial Sequence: Synthetic peptide
FTFRSHAMS

SEQ ID NO: 254 - protein, 9 aa, Artificial Sequence
  Description of Artificial Sequence: Synthetic peptide
FTFRSYAMS

SEQ ID NO: 255 - protein, 9 aa, Artificial Sequence
  Description of Artificial Sequence: Synthetic peptide
FTFSAYSMS

SEQ ID NO: 256 - protein, 13 aa, Artificial Sequence
  Description of Artificial Sequence: Synthetic peptide
AAISGSGGSTYYA

SEQ ID NO: 257 - protein, 13 aa, Artificial Sequence
  Description of Artificial Sequence: Synthetic peptide
SAISGSGGSTNYA

SEQ ID NO: 258 - protein, 13 aa, Artificial Sequence
  Description of Artificial Sequence: Synthetic peptide
SGISGSGGTTYYG

SEQ ID NO: 259 - protein, 13 aa, Artificial Sequence
  Description of Artificial Sequence: Synthetic peptide
SGISGSGGTTYYG

SEQ ID NO: 260 - protein, 13 aa, Artificial Sequence
  Description of Artificial Sequence: Synthetic peptide
SGISGSGAGTYYA

SEQ ID NO: 261 - protein, 13 aa, Artificial Sequence
  Description of Artificial Sequence: Synthetic peptide
SGISGAGASTYYA

SEQ ID NO: 262 - protein, 13 aa, Artificial Sequence
  Description of Artificial Sequence: Synthetic peptide
SGISGSGASTYYA

SEQ ID NO: 263 - protein, 13 aa, Artificial Sequence
  Description of Artificial Sequence: Synthetic peptide
SGISGSGASTYYA

SEQ ID NO: 264 - protein, 13 aa, Artificial Sequence
  Description of Artificial Sequence: Synthetic peptide
SGISGSGAGTYYA

SEQ ID NO: 265 - protein, 13 aa, Artificial Sequence
  Description of Artificial Sequence: Synthetic peptide
SSISGGGASTYYA

SEQ ID NO: 266 - protein, 13 aa, Artificial Sequence
  Description of Artificial Sequence: Synthetic peptide
SSISGGGASTYYA

SEQ ID NO: 267 - protein, 13 aa, Artificial Sequence
  Description of Artificial Sequence: Synthetic peptide
SSISGGGASTYYA

SEQ ID NO: 268 - protein, 13 aa, Artificial Sequence
  Description of Artificial Sequence: Synthetic peptide
SSISGGGASTYYA

SEQ ID NO: 269 - protein, 13 aa, Artificial Sequence
  Description of Artificial Sequence: Synthetic peptide
SSISGGGASTYYA

SEQ ID NO: 270 - protein, 13 aa, Artificial Sequence
  Description of Artificial Sequence: Synthetic peptide
SAISGSGGSRYYA

SEQ ID NO: 271 - protein, 18 aa, Artificial Sequence
  Description of Artificial Sequence: Synthetic peptide
CAKDRGYSSSWYGGFDYW

SEQ ID NO: 272 - protein, 18 aa, Artificial Sequence
  Description of Artificial Sequence: Synthetic peptide
CARGLKFLEWLPSAFDIW

SEQ ID NO: 273 - protein, 17 aa, Artificial Sequence
  Description of Artificial Sequence: Synthetic peptide
CARGTRFLEWSLPLDVW

SEQ ID NO: 274 - protein, 17 aa, Artificial Sequence
  Description of Artificial Sequence: Synthetic peptide
CARGTRFLQWSLPLDVW

SEQ ID NO: 275 - protein, 16 aa, Artificial Sequence
  Description of Artificial Sequence: Synthetic peptide
CARHAWWKGAGFFDHW

SEQ ID NO: 276 - protein, 16 aa, Artificial Sequence
  Description of Artificial Sequence: Synthetic peptide
CARHTWWKGAGFFDHW

SEQ ID NO: 277 - protein, 16 aa, Artificial Sequence
  Description of Artificial Sequence: Synthetic peptide
CARHTWWKGAGFFDHW

SEQ ID NO: 278 - protein, 16 aa, Artificial Sequence
  Description of Artificial Sequence: Synthetic peptide
CARHTWWKGAGFFDHW

SEQ ID NO: 279 - protein, 16 aa, Artificial Sequence
  Description of Artificial Sequence: Synthetic peptide
CARHTWWKGAGFFDHW

SEQ ID NO: 280 - protein, 21 aa, Artificial Sequence
  Description of Artificial Sequence: Synthetic peptide
CARVKYLTTSSGWPRPYFDNW

SEQ ID NO: 281 - protein, 21 aa, Artificial Sequence
  Description of Artificial Sequence: Synthetic peptide
CARVKYLTTSSGWPRPYFDNW

SEQ ID NO: 282 - protein, 21 aa, Artificial Sequence
  Description of Artificial Sequence: Synthetic peptide
CARVKYLTTSSGWPRPYFDNW

SEQ ID NO: 283 - protein, 21 aa, Artificial Sequence
  Description of Artificial Sequence: Synthetic peptide
CARVKYLTTSSGWPRPYFDNW

SEQ ID NO: 284 - protein, 21 aa, Artificial Sequence
  Description of Artificial Sequence: Synthetic peptide
CARVKYLTTSSGWPRPYFDNW

SEQ ID NO: 285 - protein, 16 aa, Artificial Sequence
  Description of Artificial Sequence: Synthetic peptide
CGRSKWPQANGAFDIW

SEQ ID NO: 286 - protein, 11 aa, Artificial Sequence
  Description of Artificial Sequence: Synthetic peptide
RASQTIYSYLN

SEQ ID NO: 287 - protein, 11 aa, Artificial Sequence
  Description of Artificial Sequence: Synthetic peptide
RTSQSINTYLN

SEQ ID NO: 288 - protein, 11 aa, Artificial Sequence
  Description of Artificial Sequence: Synthetic peptide
RASRSISRYLN

SEQ ID NO: 289 - protein, 11 aa, Artificial Sequence
  Description of Artificial Sequence: Synthetic peptide
RASRSIRRYLN

SEQ ID NO: 290 - protein, 11 aa, Artificial Sequence
  Description of Artificial Sequence: Synthetic peptide
RASQSIGRYLN

SEQ ID NO: 291 - protein, 11 aa, Artificial Sequence
  Description of Artificial Sequence: Synthetic peptide
RASQSIGKYLN

SEQ ID NO: 292 - protein, 11 aa, Artificial Sequence
  Description of Artificial Sequence: Synthetic peptide
RASQSIGRYLN

SEQ ID NO: 293 - protein, 11 aa, Artificial Sequence
  Description of Artificial Sequence: Synthetic peptide
RASQSIGRYLN

SEQ ID NO: 294 - protein, 11 aa, Artificial Sequence
  Description of Artificial Sequence: Synthetic peptide
RASQSIGRYLN

SEQ ID NO: 295 - protein, 11 aa, Artificial Sequence
  Description of Artificial Sequence: Synthetic peptide
RASQSIRKYLN

SEQ ID NO: 296 - protein, 11 aa, Artificial Sequence
  Description of Artificial Sequence: Synthetic peptide
RASQSIGKYLN

SEQ ID NO: 297 - protein, 11 aa, Artificial Sequence
  Description of Artificial Sequence: Synthetic peptide
RASQSIGKYLN

SEQ ID NO: 298 - protein, 11 aa, Artificial Sequence
  Description of Artificial Sequence: Synthetic peptide
RASQSIGKYLN

SEQ ID NO: 299 - protein, 11 aa, Artificial Sequence
  Description of Artificial Sequence: Synthetic peptide
RASQSIGKYLN

SEQ ID NO: 300 - protein, 11 aa, Artificial Sequence
  Description of Artificial Sequence: Synthetic peptide
RASQNIKTYLN

SEQ ID NO: 301 - protein, 7 aa, Artificial Sequence
  Description of Artificial Sequence: Synthetic peptide
ATSTLQG

SEQ ID NO: 302 - protein, 7 aa, Artificial Sequence
  Description of Artificial Sequence: Synthetic peptide
GASNVQS

SEQ ID NO: 303 - protein, 7 aa, Artificial Sequence
  Description of Artificial Sequence: Synthetic peptide
AASSLQA

SEQ ID NO: 304 - protein, 7 aa, Artificial Sequence
  Description of Artificial Sequence: Synthetic peptide
ASSSLQA

SEQ ID NO: 305 - protein, 7 aa, Artificial Sequence
  Description of Artificial Sequence: Synthetic peptide
AASSLKS

SEQ ID NO: 306 - protein, 7 aa, Artificial Sequence
  Description of Artificial Sequence: Synthetic peptide
ASSSLQS

SEQ ID NO: 307 - protein, 7 aa, Artificial Sequence
  Description of Artificial Sequence: Synthetic peptide
ASSSLQS

SEQ ID NO: 308 - protein, 7 aa, Artificial Sequence
  Description of Artificial Sequence: Synthetic peptide
AASSLKS

SEQ ID NO: 309 - protein, 7 aa, Artificial Sequence
  Description of Artificial Sequence: Synthetic peptide
AASSLKS

SEQ ID NO: 310 - protein, 7 aa, Artificial Sequence
  Description of Artificial Sequence: Synthetic peptide
ASSTLQR

SEQ ID NO: 311 - protein, 7 aa, Artificial Sequence
  Description of Artificial Sequence: Synthetic peptide
ASSTLQR

SEQ ID NO: 312 - protein, 7 aa, Artificial Sequence
  Description of Artificial Sequence: Synthetic peptide
ASSTLQR

SEQ ID NO: 313 - protein, 7 aa, Artificial Sequence
  Description of Artificial Sequence: Synthetic peptide
ASSTLQR

SEQ ID NO: 314 - protein, 7 aa, Artificial Sequence
  Description of Artificial Sequence: Synthetic peptide
ASSTLQR

SEQ ID NO: 315 - protein, 7 aa, Artificial Sequence
  Description of Artificial Sequence: Synthetic peptide
AASKLQS

SEQ ID NO: 316 - protein, 7 aa, Artificial Sequence [sequence omitted]

SEQ ID NO: 317 - protein, 11 aa, Artificial Sequence [sequence omitted]

SEQ ID NO: 318 - protein, 11 aa, Artificial Sequence [sequence omitted]

SEQ ID NO: 319 - protein, 11 aa, Artificial Sequence [sequence omitted]

SEQ ID NO: 320 - protein, 11 aa, Artificial Sequence [sequence omitted]

SEQ ID NO: 321 - protein, 11 aa, Artificial Sequence [sequence omitted]

SEQ ID NO: 322 - protein, 11 aa, Artificial Sequence [sequence omitted]

SEQ ID NO: 323 - protein, 11 aa, Artificial Sequence [sequence omitted]

SEQ ID NO: 324 - protein, 11 aa, Artificial Sequence [sequence omitted]

SEQ ID NO: 325 - protein, 11 aa, Artificial Sequence [sequence omitted]

SEQ ID NO: 326 - protein, 11 aa, Artificial Sequence
  Description of Artificial Sequence: Synthetic peptide
CQQSLSPPFTF

SEQ ID NO: 327 - protein, 11 aa, Artificial Sequence [sequence omitted]

SEQ ID NO: 328 - protein, 11 aa, Artificial Sequence
  Description of Artificial Sequence: Synthetic peptide
CQQSFSPPFTF

SEQ ID NO: 329 - protein, 11 aa, Artificial Sequence [sequence omitted]

SEQ ID NO: 330 - protein, 11 aa, Artificial Sequence [sequence omitted]

SEQ ID NO: 331 - protein, 9 aa, Artificial Sequence
  Description of Artificial Sequence: Synthetic peptide
FTFSNYATD

SEQ ID NO: 332 - protein, 9 aa, Artificial Sequence
  Description of Artificial Sequence: Synthetic peptide
FTFSAFAMG

SEQ ID NO: 333 - protein, 9 aa, Artificial Sequence
  Description of Artificial Sequence: Synthetic peptide
FTFSDFAMA

SEQ ID NO: 334 - protein, 9 aa, Artificial Sequence
  Description of Artificial Sequence: Synthetic peptide
FTFSRHAMN

SEQ ID NO: 335 - protein, 9 aa, Artificial Sequence
  Description of Artificial Sequence: Synthetic peptide
FTFSDFAMA

SEQ ID NO: 336 - protein, 9 aa, Artificial Sequence
  Description of Artificial Sequence: Synthetic peptide
FTFSNYPMN

SEQ ID NO: 337 - protein, 9 aa, Artificial Sequence
  Description of Artificial Sequence: Synthetic peptide
FTFSDFAMA

SEQ ID NO: 338 - protein, 9 aa, Artificial Sequence
  Description of Artificial Sequence: Synthetic peptide
FTFSDYPMN

SEQ ID NO: 339 - protein, 9 aa, Artificial Sequence
  Description of Artificial Sequence: Synthetic peptide
FTFSDYPMN

SEQ ID NO: 340 - protein, 9 aa, Artificial Sequence
  Description of Artificial Sequence: Synthetic peptide
FTFSDFAMA

SEQ ID NO: 341 - protein, 9 aa, Artificial Sequence
  Description of Artificial Sequence: Synthetic peptide
FTFSDYPMN

SEQ ID NO: 342 - protein, 9 aa, Artificial Sequence
  Description of Artificial Sequence: Synthetic peptide
FTFSDFAMA

SEQ ID NO: 343 - protein, 9 aa, Artificial Sequence
  Description of Artificial Sequence: Synthetic peptide
FTFSDFAMA

SEQ ID NO: 344 - protein, 9 aa, Artificial Sequence
  Description of Artificial Sequence: Synthetic peptide
FTFPRYAMS

SEQ ID NO: 345 - protein, 9 aa, Artificial Sequence
  Description of Artificial Sequence: Synthetic peptide
FTFSSYAMS

SEQ ID NO: 346 - protein, 9 aa, Artificial Sequence
  Description of Artificial Sequence: Synthetic peptide
FTFSNYAMS

SEQ ID NO: 347 - protein, 9 aa, Artificial Sequence
  Description of Artificial Sequence: Synthetic peptide
FTFSSYAMY

SEQ ID NO: 348 - protein, 9 aa, Artificial Sequence
  Description of Artificial Sequence: Synthetic peptide
FTFSSYTMS

SEQ ID NO: 349 - protein, 9 aa, Artificial Sequence
  Description of Artificial Sequence: Synthetic peptide
FTFSSYDMS

SEQ ID NO: 350 - protein, 9 aa, Artificial Sequence
  Description of Artificial Sequence: Synthetic peptide
FTFPRYAMS

SEQ ID NO: 351 - protein, 9 aa, Artificial Sequence
  Description of Artificial Sequence: Synthetic peptide
FTFTTYALS

SEQ ID NO: 352 - protein, 9 aa, Artificial Sequence
  Description of Artificial Sequence: Synthetic peptide
FTFSRHAMN

SEQ ID NO: 353 - protein, 9 aa, Artificial Sequence
  Description of Artificial Sequence: Synthetic peptide
FVFSSYAMS

SEQ ID NO: 354 - protein, 9 aa, Artificial Sequence
  Description of Artificial Sequence: Synthetic peptide
FTLSSYVMS

SEQ ID NO: 355 - protein, 9 aa, Artificial Sequence
  Description of Artificial Sequence: Synthetic peptide
FTFSTYAMS

SEQ ID NO: 356 - protein, 9 aa, Artificial Sequence
  Description of Artificial Sequence: Synthetic peptide
FTYSNYAMT

SEQ ID NO: 357 - protein, 9 aa, Artificial Sequence
  Description of Artificial Sequence: Synthetic peptide
FTFSNYPMN

SEQ ID NO: 358 - protein, 13 aa, Artificial Sequence
  Description of Artificial Sequence: Synthetic peptide
SIISGSGGATYYA

SEQ ID NO: 359 - protein, 13 aa, Artificial Sequence
  Description of Artificial Sequence: Synthetic peptide
SAITASGDITYYA

SEQ ID NO: 360 - protein, 13 aa, Artificial Sequence
  Description of Artificial Sequence: Synthetic peptide
SAISGSGDITYYA

SEQ ID NO: 361 - protein, 13 aa, Artificial Sequence
  Description of Artificial Sequence: Synthetic peptide
SGISGSGDETYYA

SEQ ID NO: 362 - protein, 13 aa, Artificial Sequence
  Description of Artificial Sequence: Synthetic peptide
SAISGSGDITYYA

SEQ ID NO: 363 - protein, 13 aa, Artificial Sequence
  Description of Artificial Sequence: Synthetic peptide
STISGSGGNTFYA

SEQ ID NO: 364 - protein, 13 aa, Artificial Sequence
  Description of Artificial Sequence: Synthetic peptide
SAITGSGDITYYA

SEQ ID NO: 365 - protein, 13 aa, Artificial Sequence
  Description of Artificial Sequence: Synthetic peptide
STISGSGGITFYA

SEQ ID NO: 366 - protein, 13 aa, Artificial Sequence
  Description of Artificial Sequence: Synthetic peptide
SAISGSGDNTYYA

SEQ ID NO: 367 - protein, 13 aa, Artificial Sequence
  Description of Artificial Sequence: Synthetic peptide
SAITGTGDITYYA

SEQ ID NO: 368 - protein, 13 aa, Artificial Sequence
  Description of Artificial Sequence: Synthetic peptide
SAITGSGDITYYA

SEQ ID NO: 369 - protein, 13 aa, Artificial Sequence
  Description of Artificial Sequence: Synthetic peptide
SAISGSGDITYYA

SEQ ID NO: 370 - protein, 13 aa, Artificial Sequence
  Description of Artificial Sequence: Synthetic peptide
SAISGSGDITYYA

SEQ ID NO: 371 - protein, 13 aa, Artificial Sequence
  Description of Artificial Sequence: Synthetic peptide
STISGSGSTTYYA

SEQ ID NO: 372 - protein, 13 aa, Artificial Sequence
  Description of Artificial Sequence: Synthetic peptide
SVISGSGGSTYYA

SEQ ID NO: 373 - protein, 13 aa, Artificial Sequence
  Description of Artificial Sequence: Synthetic peptide
SAISGSAGSTYYA

SEQ ID NO: 374 - protein, 13 aa, Artificial Sequence
  Description of Artificial Sequence: Synthetic peptide
SAISGSAGSTYYA

SEQ ID NO: 375 - protein, 13 aa, Artificial Sequence
  Description of Artificial Sequence: Synthetic peptide
SVISGSGGSTYYA

SEQ ID NO: 376 - protein, 13 aa, Artificial Sequence
  Description of Artificial Sequence: Synthetic peptide
SVISGSGGSTYYA

SEQ ID NO: 377 - protein, 13 aa, Artificial Sequence
  Description of Artificial Sequence: Synthetic peptide
STISGSGSTTYYA

SEQ ID NO: 378 - protein, 13 aa, Artificial Sequence
  Description of Artificial Sequence: Synthetic peptide
SGISGSGDETYYA

SEQ ID NO: 379 - protein, 13 aa, Artificial Sequence
  Description of Artificial Sequence: Synthetic peptide
SGITGSGDETYYA

SEQ ID NO: 380 - protein, 13 aa, Artificial Sequence
  Description of Artificial Sequence: Synthetic peptide
SAISGSGGSSYYA

SEQ ID NO: 381 - protein, 13 aa, Artificial Sequence
  Description of Artificial Sequence: Synthetic peptide
SGISGGGASTYYA

SEQ ID NO: 382 - protein, 13 aa, Artificial Sequence
  Description of Artificial Sequence: Synthetic peptide
SSIGGSGSTTYYA

SEQ ID NO: 383 - protein, 13 aa, Artificial Sequence
  Description of Artificial Sequence: Synthetic peptide
SAISGSSGSTYYA

SEQ ID NO: 384 - protein, 13 aa, Artificial Sequence
  Description of Artificial Sequence: Synthetic peptide
STISGSGGNTFYA

SEQ ID NO: 385 - protein, 21 aa, Artificial Sequence
  Description of Artificial Sequence: Synthetic peptide
CAKGGYCSSDTCWWEYWLDPW

SEQ ID NO: 386 - protein, 17 aa, Artificial Sequence
  Description of Artificial Sequence: Synthetic peptide
CARQSDGLPSPWHFDLG

SEQ ID NO: 387 - protein, 17 aa, Artificial Sequence
  Description of Artificial Sequence: Synthetic peptide
CAREADGLHSPWHFDLW

SEQ ID NO: 388 - protein, 24 aa, Artificial Sequence
  Description of Artificial Sequence: Synthetic peptide
CARDLPASYYDSSGYYWHNGMDVW

SEQ ID NO: 389 - protein, 17 aa, Artificial Sequence
  Description of Artificial Sequence: Synthetic peptide
CAREADGLHSPWHFDLW

SEQ ID NO: 390 - protein, 12 aa, Artificial Sequence
  Description of Artificial Sequence: Synthetic peptide
CVRHDEYSFDYW

SEQ ID NO: 391 - protein, 17 aa, Artificial Sequence
  Description of Artificial Sequence: Synthetic peptide
CAREADGLHSPWHFDLW

SEQ ID NO: 392 - protein, 12 aa, Artificial Sequence
  Description of Artificial Sequence: Synthetic peptide
CVRHDEYSFDYW

SEQ ID NO: 393 - protein, 12 aa, Artificial Sequence
  Description of Artificial Sequence: Synthetic peptide
CVRHDEYSFDYW

SEQ ID NO: 394 - protein, 12 aa, Artificial Sequence
  Description of Artificial Sequence: Synthetic peptide
CAREADGLHSPW

SEQ ID NO: 395 - protein, 12 aa, Artificial Sequence
  Description of Artificial Sequence: Synthetic peptide
CVRHDEYSFDYW

SEQ ID NO: 396 - protein, 17 aa, Artificial Sequence
  Description of Artificial Sequence: Synthetic peptide
CAREADGLHSPWHFDLW

SEQ ID NO: 397 - protein, 17 aa, Artificial Sequence
  Description of Artificial Sequence: Synthetic peptide
CAREADGLHSPWHFDLW

SEQ ID NO: 398 - protein, 11 aa, Artificial Sequence
  Description of Artificial Sequence: Synthetic peptide
CARLIDAFDIW

SEQ ID NO: 399 - protein, 16 aa, Artificial Sequence
  Description of Artificial Sequence: Synthetic peptide
CAREGYRDYLWYFDLW

SEQ ID NO: 400 - protein, 18 aa, Artificial Sequence
  Description of Artificial Sequence: Synthetic peptide
CARVRQGLRRTWYYFDYW

SEQ ID NO: 401 - protein, 18 aa, Artificial Sequence
  Description of Artificial Sequence: Synthetic peptide
CARDTNDFWSGYSIFDPW

SEQ ID NO: 402 - protein, 16 aa, Artificial Sequence
  Description of Artificial Sequence: Synthetic peptide
CAREGYRDYLWYFDLW

SEQ ID NO: 403 - protein, 14 aa, Artificial Sequence
  Description of Artificial Sequence: Synthetic peptide
CAKGPLVGWYFDLW

SEQ ID NO: 404 - protein, 11 aa, Artificial Sequence
  Description of Artificial Sequence: Synthetic peptide
CARLIDAFDIW

SEQ ID NO: 405 - protein, 17 aa, Artificial Sequence
  Description of Artificial Sequence: Synthetic peptide
CTTGDDFWSGGNWFDPW

SEQ ID NO: 406 - protein, 24 aa, Artificial Sequence
  Description of Artificial Sequence: Synthetic peptide
CARDLPASYYDSSGYYWHNGMDVW

SEQ ID NO: 407 - protein, 15 aa, Artificial Sequence
  Description of Artificial Sequence: Synthetic peptide
CARVGGGYWYGIDVW

SEQ ID NO: 408 - protein, 17 aa, Artificial Sequence
  Description of Artificial Sequence: Synthetic peptide
CARGYSRNWYPSWFDPW

SEQ ID NO: 409 - protein, 10 aa, Artificial Sequence
  Description of Artificial Sequence: Synthetic peptide
CAGGWYLDYW

SEQ ID NO: 410 - protein, 13 aa, Artificial Sequence
  Description of Artificial Sequence: Synthetic peptide
CASLCIVDPFDIW

SEQ ID NO: 411 - protein, 12 aa, Artificial Sequence
  Description of Artificial Sequence: Synthetic peptide
CVRHDEYSFDYW

SEQ ID NO: 412 - protein, 11 aa, Artificial Sequence
  Description of Artificial Sequence: Synthetic peptide
RASQSIHRFLN

SEQ ID NO: 413 - protein, 11 aa, Artificial Sequence
  Description of Artificial Sequence: Synthetic peptide
RASQSIHISLN

SEQ ID NO: 414 - protein, 11 aa, Artificial Sequence
  Description of Artificial Sequence: Synthetic peptide
RASQSIHTYLN

SEQ ID NO: 415 - protein, 11 aa, Artificial Sequence
  Description of Artificial Sequence: Synthetic peptide
RASQTINTYLN

SEQ ID NO: 416 - protein, 11 aa, Artificial Sequence
  Description of Artificial Sequence: Synthetic peptide
RASQSIDTYLN

SEQ ID NO: 417 - protein, 11 aa, Artificial Sequence
  Description of Artificial Sequence: Synthetic peptide
RASQSIGNYLN

SEQ ID NO: 418 - protein, 11 aa, Artificial Sequence
  Description of Artificial Sequence: Synthetic peptide
RASQSIDTYLN

SEQ ID NO: 419 - protein, 11 aa, Artificial Sequence
  Description of Artificial Sequence: Synthetic peptide
RASQSIDNYLN

SEQ ID NO: 420 - protein, 11 aa, Artificial Sequence
  Description of Artificial Sequence: Synthetic peptide
RASQSIDTYLN

SEQ ID NO: 421 - protein, 11 aa, Artificial Sequence
  Description of Artificial Sequence: Synthetic peptide
RASQSIDTYLN

SEQ ID NO: 422 - protein, 11 aa, Artificial Sequence
  Description of Artificial Sequence: Synthetic peptide
RASQSIDTYLN

SEQ ID NO: 423 - protein, 11 aa, Artificial Sequence
  Description of Artificial Sequence: Synthetic peptide
RASQSIDTYLN

SEQ ID NO: 424 - protein, 11 aa, Artificial Sequence
  Description of Artificial Sequence: Synthetic peptide
RASQSIDNYLN

SEQ ID NO: 425 - protein, 11 aa, Artificial Sequence
  Description of Artificial Sequence: Synthetic peptide
RASQRIGTYLN

SEQ ID NO: 426 - protein, 14 aa, Artificial Sequence
  Description of Artificial Sequence: Synthetic peptide
TGTSSDVGSYDLVS

SEQ ID NO: 427 - protein, 14 aa, Artificial Sequence
  Description of Artificial Sequence: Synthetic peptide
TGTSSDVGSSNLVS

SEQ ID NO: 428 - protein, 14 aa, Artificial Sequence
  Description of Artificial Sequence: Synthetic peptide
TGTSSDIGSYNLVS

SEQ ID NO: 429 - protein, 14 aa, Artificial Sequence
  Description of Artificial Sequence: Synthetic peptide
TGTSTDVGSYNLVS

SEQ ID NO: 430 - protein, 14 aa, Artificial Sequence
  Description of Artificial Sequence: Synthetic peptide
TGTSSNVGSYNLVS

SEQ ID NO: 431 - protein, 11 aa, Artificial Sequence
  Description of Artificial Sequence: Synthetic peptide
RASQSIHTYLN

SEQ ID NO: 432 - protein, 11 aa, Artificial Sequence
  Description of Artificial Sequence: Synthetic peptide
RASQSIHTYLN

SEQ ID NO: 433 - protein, 11 aa, Artificial Sequence
  Description of Artificial Sequence: Synthetic peptide
RASQTINTFLN

SEQ ID NO: 434 - protein, 11 aa, Artificial Sequence
  Description of Artificial Sequence: Synthetic peptide
RASQTIRTYLN

SEQ ID NO: 435 - protein, 11 aa, Artificial Sequence
  Description of Artificial Sequence: Synthetic peptide
RSSQSISSYLN

SEQ ID NO: 436 - protein, 11 aa, Artificial Sequence
  Description of Artificial Sequence: Synthetic peptide
RASQSISGSLN

SEQ ID NO: 437 - protein, 11 aa, Artificial Sequence
  Description of Artificial Sequence: Synthetic peptide
RASRSISTYLN

SEQ ID NO: 438 - protein, 11 aa, Artificial Sequence
  Description of Artificial Sequence: Synthetic peptide
RASQSIHTYLN

SEQ ID NO: 439 - protein, 7 aa, Artificial Sequence
  Description of Artificial Sequence: Synthetic peptide
AASNLHS

SEQ ID NO: 440 - protein, 7 aa, Artificial Sequence
  Description of Artificial Sequence: Synthetic peptide
LASPLAS

SEQ ID NO: 441 - protein, 7 aa, Artificial Sequence
  Description of Artificial Sequence: Synthetic peptide
AASALAS

SEQ ID NO: 442 - protein, 7 aa, Artificial Sequence
  Description of Artificial Sequence: Synthetic peptide
SASTLQS

SEQ ID NO: 443 - protein, 7 aa, Artificial Sequence
  Description of Artificial Sequence: Synthetic peptide
AASALAS

SEQ ID NO: 444 - protein, 7 aa, Artificial Sequence
  Description of Artificial Sequence: Synthetic peptide
GVSSLQS

SEQ ID NO: 445 - protein, 7 aa, Artificial Sequence
  Description of Artificial Sequence: Synthetic peptide
AASALAS

SEQ ID NO: 446 - protein, 7 aa, Artificial Sequence
  Description of Artificial Sequence: Synthetic peptide
GVSALQS

SEQ ID NO: 447 - protein, 7 aa, Artificial Sequence
  Description of Artificial Sequence: Synthetic peptide
GASALES

SEQ ID NO: 448 - protein, 7 aa, Artificial Sequence
  Description of Artificial Sequence: Synthetic peptide
AASALAS

SEQ ID NO: 449 - protein, 7 aa, Artificial Sequence
  Description of Artificial Sequence: Synthetic peptide
GVSALQS

SEQ ID NO: 450 - protein, 7 aa, Artificial Sequence
  Description of Artificial Sequence: Synthetic peptide
AASALAS

SEQ ID NO: 451 - protein, 7 aa, Artificial Sequence
  Description of Artificial Sequence: Synthetic peptide
GVSALQS

SEQ ID NO: 452 - protein, 7 aa, Artificial Sequence
  Description of Artificial Sequence: Synthetic peptide
AASNLEG

SEQ ID NO: 453 - protein, 7 aa, Artificial Sequence
  Description of Artificial Sequence: Synthetic peptide
EGNKRPS

SEQ ID NO: 454 - protein, 7 aa, Artificial Sequence
  Description of Artificial Sequence: Synthetic peptide
EGSKRPS

SEQ ID NO: 455 - protein, 7 aa, Artificial Sequence
  Description of Artificial Sequence: Synthetic peptide
EGTKRPS

SEQ ID NO: 456 - protein, 7 aa, Artificial Sequence
  Description of Artificial Sequence: Synthetic peptide
EGTKRPS

SEQ ID NO: 457 - protein, 7 aa, Artificial Sequence
  Description of Artificial Sequence: Synthetic peptide
EGTKRPS

SEQ ID NO: 458 - protein, 7 aa, Artificial Sequence
  Description of Artificial Sequence: Synthetic peptide
AASALAS

SEQ ID NO: 459 - protein, 7 aa, Artificial Sequence
  Description of Artificial Sequence: Synthetic peptide
AASALAS

SEQ ID NO: 460 - protein, 7 aa, Artificial Sequence
  Description of Artificial Sequence: Synthetic peptide
SASTLQS

SEQ ID NO: 461 - protein, 7 aa, Artificial Sequence
  Description of Artificial Sequence: Synthetic peptide
DASTLQR

SEQ ID NO: 462 - protein, 7 aa, Artificial Sequence
  Description of Artificial Sequence: Synthetic peptide
GASRLRS

SEQ ID NO: 463 - protein, 7 aa, Artificial Sequence
  Description of Artificial Sequence: Synthetic peptide
AESRLHS

SEQ ID NO: 464 - protein, 7 aa, Artificial Sequence
  Description of Artificial Sequence: Synthetic peptide
AASNLQG

SEQ ID NO: 465 - protein, 7 aa, Artificial Sequence
  Description of Artificial Sequence: Synthetic peptide
AASALAS

SEQ ID NO: 466 - protein, 11 aa, Artificial Sequence
  Description of Artificial Sequence: Synthetic peptide
CQQSYGLPPTF

SEQ ID NO: 467 - protein, 12 aa, Artificial Sequence [sequence omitted]

SEQ ID NO: 468 - protein, 12 aa, Artificial Sequence [sequence omitted]

SEQ ID NO: 469 - protein, 10 aa, Artificial Sequence [sequence omitted]

SEQ ID NO: 470 - protein, 12 aa, Artificial Sequence [sequence omitted]

SEQ ID NO: 471 - protein, 11 aa, Artificial Sequence [sequence omitted]

SEQ ID NO: 472 - protein, 12 aa, Artificial Sequence [sequence omitted]

SEQ ID NO: 473 - protein, 12 aa, Artificial Sequence
  Description of Artificial Sequence: Synthetic peptide
CQQSHSAPPYFF

SEQ ID NO: 474 - protein, 12 aa, Artificial Sequence
  Description of Artificial Sequence: Synthetic peptide
CQQSHSAPPYFF

SEQ ID NO: 475 - protein, 12 aa, Artificial Sequence [sequence omitted]

SEQ ID NO: 476 - protein, 12 aa, Artificial Sequence
  Description of Artificial Sequence: Synthetic peptide
CQQSYSAPPYFF

SEQ ID NO: 477 - protein, 12 aa, Artificial Sequence [sequence omitted]

SEQ ID NO: 478 - protein, 11 aa, Artificial Sequence [sequence omitted]

SEQ ID NO: 479 - protein, 11 aa, Artificial Sequence
  Description of Artificial Sequence: Synthetic peptide
CQQNYSTTWTF

SEQ ID NO: 480 - protein, 11 aa, Artificial Sequence [sequence omitted]

SEQ ID NO: 481 - protein, 11 aa, Artificial Sequence [sequence omitted]

SEQ ID NO: 482 - protein, 12 aa, Artificial Sequence [sequence omitted]

SEQ ID NO: 483 - protein, 13 aa, Artificial Sequence [sequence omitted]

SEQ ID NO: 484 - protein, 13 aa, Artificial Sequence [sequence omitted]

SEQ ID NO: 485 - protein, 12 aa, Artificial Sequence [sequence omitted]

SEQ ID NO: 486 - protein, 12 aa, Artificial Sequence [sequence omitted]

SEQ ID NO: 487 - protein, 10 aa, Artificial Sequence [sequence omitted]

SEQ ID NO: 488 - protein, 12 aa, Artificial Sequence [sequence omitted]

SEQ ID NO: 489 - protein, 11 aa, Artificial Sequence
  Description of Artificial Sequence: Synthetic peptide
CQQGYSAPWTF

SEQ ID NO: 490 - protein, 11 aa, Artificial Sequence [sequence omitted]

SEQ ID NO: 491 - protein, 11 aa, Artificial Sequence [sequence omitted]

SEQ ID NO: 492 - protein, 12 aa, Artificial Sequence [sequence omitted]

SEQ ID NO: 493 - protein, 126 aa, Artificial Sequence
  Description of Artificial Sequence: Synthetic polypeptide
EVQLLESGGGLVQPGGSLRLSCAASGFTFSNYATDWVRQAPGKGLEWVSIISGSGGATYYADSVKGRFTISRDNSKNTLYLQMNSLRAEDTAVYYCAKGGYCSSDTCWWEYWLDPWGQGTLVTVSS

SEQ ID NO: 494 - protein, 122 aa, Artificial Sequence
  Description of Artificial Sequence: Synthetic polypeptide
EVQLLESGGGLVQPGGSLRLSCAASGFTFSAFAMGWVRQAPGKGLEWVSAITASGDITYYADSVKGRFTISRDNSKNTLYLQMNSLRAEDTAVYYCARQSDGLPSPWHFDLGGQGTLVTVSS

SEQ ID NO: 495 - protein, 122 aa, Artificial Sequence
  Description of Artificial Sequence: Synthetic polypeptide
EVQLLESGGGLVQPGGSLRLSCAASGFTFSDFAMAWVRQAPGKGLEWVSAISGSGDITYYADSVKGRFTISRDNSKNTLYLQMNSLRAEDTAVYYCAREADGLHSPWHFDLWGQGTLVTVSS

SEQ ID NO: 496 - protein, 129 aa, Artificial Sequence
  Description of Artificial Sequence: Synthetic polypeptide
EVQLLESGGGLVQPGGSLRLSCAASGFTFSRHAMNWVRQAPGKGLEWVSGISGSGDETYYADSVKGRFTISRDNSKNTLYLQMNSLRAEDTAVYYCARDLPASYYDSSGYYWHNGMDVWGQGTLVTVSS

SEQ ID NO: 497 - protein, 122 aa, Artificial Sequence; identical to SEQ ID NO: 495
  Description of Artificial Sequence: Synthetic polypeptide

SEQ ID NO: 498 - protein, 117 aa, Artificial Sequence
  Description of Artificial Sequence: Synthetic polypeptide
EVQLLESGGGLVQPGGSLRLSCAASGFTFSNYPMNWVRQAPGKGLEWVSTISGSGGNTFYADSVKGRFTISRDNSKNTLYLQMNSLRAEDTAVYYCVRHDEYSFDYWGQGTLVTVSS

SEQ ID NO: 499 - protein, 122 aa, Artificial Sequence
  Description of Artificial Sequence: Synthetic polypeptide
EVQLLESGGGLVQPGGSLRLSCAASGFTFSDFAMAWVRQAPGKGLEWVSAITGSGDITYYADSVKGRFTISRDNSKNTLYLQMNSLRAEDTAVYYCAREADGLHSPWHFDLWGQGTLVTVSS

SEQ ID NO: 500 - protein, 117 aa, Artificial Sequence
  Description of Artificial Sequence: Synthetic polypeptide
EVQLLESGGGLVQPGGSLRLSCAASGFTFSDYPMNWVRQAPGKGLEWVSTISGSGGITFYADSVKGRFTISRDNSKNTLYLQMNSLRAEDTAVYYCVRHDEYSFDYWGQGTLVTVSS

SEQ ID NO: 501 - protein, 117 aa, Artificial Sequence
  Description of Artificial Sequence: Synthetic polypeptide
EVQLLESGGGLVQPGGSLRLSCAASGFTFSDYPMNWVRQAPGKGLEWVSAISGSGDNTYYADSVKGRFTISRDNSKNTLYLQMNSLRAEDTAVYYCVRHDEYSFDYWGQGTLVTVSS

SEQ ID NO: 502 - protein, 117 aa, Artificial Sequence
  Description of Artificial Sequence: Synthetic polypeptide
EVQLLESGGGLVQPGGSLRLSCAASGFTFSDFAMAWVRQAPGKGLEWVSAITGTGDITYYADSVKGRFTISRDNSKNTLYLQMNSLRAEDTAVYYCAREADGLHSPWGQGTLVTVSS

SEQ ID NO: 503 - protein, 117 aa, Artificial Sequence
  Description of Artificial Sequence: Synthetic polypeptide
EVQLLESGGGLVQPGGSLRLSCAASGFTFSDYPMNWVRQAPGKGLEWVSAITGSGDITYYADSVKGRFTISRDNSKNTLYLQMNSLRAEDTAVYYCVRHDEYSFDYWGQGTLVTVSS

SEQ ID NO: 504 - protein, 122 aa, Artificial Sequence; identical to SEQ ID NO: 495
  Description of Artificial Sequence: Synthetic polypeptide

SEQ ID NO: 505 - protein, 122 aa, Artificial Sequence; identical to SEQ ID NO: 495
  Description of Artificial Sequence: Synthetic polypeptide

SEQ ID NO: 506 - protein, 116 aa, Artificial Sequence
  Description of Artificial Sequence: Synthetic polypeptide
EVQLLESGGGLVQPGGSLRLSCAASGFTFPRYAMSWVRQAPGKGLEWVSTISGSGSTTYYADSVKGRFTISRDNSKNTLYLQMNSLRAEDTAVYYCARLIDAFDIWGQGTLVTVSS

SEQ ID NO: 507 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSVISGSGGSTYYADSVKGRFTISRDNSKNTLYLQMNSLRAEDTAVYYCAREGYRDYLWYFDLWGQGTLVTVSS

SEQ ID NO: 508 - protein, 123 aa, Artificial Sequence
  Description of Artificial Sequence: Synthetic polypeptide
EVQLLESGGGLVQPGGSLRLSCAASGFTFSNYAMSWVRQAPGKGLEWVSAISGSAGSTYYADSVKGRFTISRDNSKNTLYLQMNSLRAEDTAVYYCARVRQGLRRTWYYFDYWGQGTLVTVSS

SEQ ID NO: 509 - protein, 123 aa, Artificial Sequence
  Description of Artificial Sequence: Synthetic polypeptide
EVQLLESGGGLVQPGGSLRLSCAASGFTFSSYAMYWVRQAPGKGLEWVSAISGSAGSTYYADSVKGRFTISRDNSKNTLYLQMNSLRAEDTAVYYCARDTNDFWSGYSIFDPWGQGTLVTVSS

SEQ ID NO: 510 - protein, 121 aa, Artificial Sequence
  Description of Artificial Sequence: Synthetic polypeptide
EVQLLESGGGLVQPGGSLRLSCAASGFTFSSYTMSWVRQAPGKGLEWVSVISGSGGSTYYADSVKGRFTISRDNSKNTLYLQMNSLRAEDTAVYYCAREGYRDYLWYFDLWGQGTLVTVSS

SEQ ID NO: 511 - protein, 119 aa, Artificial Sequence
  Description of Artificial Sequence: Synthetic polypeptide
EVQLLESGGGLVQPGGSLRLSCAASGFTFSSYDMSWVRQAPGKGLEWVSVISGSGGSTYYADSVKGRFTISRDNSKNTLYLQMNSLRAEDTAVYYCAKGPLVGWYFDLWGQGTLVTVSS

SEQ ID NO: 512 - protein, 116 aa, Artificial Sequence; identical to SEQ ID NO: 506
  Description of Artificial Sequence: Synthetic polypeptide

SEQ ID NO: 513 - protein, 122 aa, Artificial Sequence
  Description of Artificial Sequence: Synthetic polypeptide
EVQLLESGGGLVQPGGSLRLSCAASGFTFTTYALSWVRQAPGKGLEWVSGISGSGDETYYADSVKGRFTISRDNSKNTLYLQMNSLRAEDTAVYYCTTGDDFWSGGNWFDPWGQGTLVTVSS

SEQ ID NO: 514 - protein, 129 aa, Artificial Sequence
  Description of Artificial Sequence: Synthetic polypeptide
EVQLLESGGGLVQPGGSLRLSCAASGFTFSRHAMNWVRQAPGKGLEWVSGITGSGDETYYADSVKGRFTISRDNSKNTLYLQMNSLKAEDTAVYYCARDLPASYYDSSGYYWHNGMDVWGQGTLVTVSS

SEQ ID NO: 515 - protein, 120 aa, Artificial Sequence
  Description of Artificial Sequence: Synthetic polypeptide
EVQLLESGGGLVQPGGSLRLSCAASGFVFSSYAMSWVRQAPGKGLEWVSAISGSGGSSYYADSVKGRFTISRDNSKNTLYLQMNSLRAEDTAVYYCARVGGGYWYGIDVWGQGTLVTVSS

SEQ ID NO: 516 - protein, 122 aa, Artificial Sequence
  Description of Artificial Sequence: Synthetic polypeptide
EVQLLESGGGLVQPGGSLRLSCAASGFTLSSYVMSWVRQAPGKGLEWVSGISGGGASTYYADSVKGRFTISRDNSKNTLYLQMNSLRAEDTAVYYCARGYSRNWYPSWFDPWGQGTLVTVSS

SEQ ID NO: 517 - protein, 115 aa, Artificial Sequence
  Description of Artificial Sequence: Synthetic polypeptide
EVQLLESGGGLVQPGGSLRLSCAASGFTFSTYAMSWVRQAPGKGLEWVSSIGGSGSTTYYADSVKGRFTISRDNSKNTLYLQMNSLRAEDTAVYYCAGGWYLDYWGQGTLVTVSS

SEQ ID NO: 518 - protein, 118 aa, Artificial Sequence
  Description of Artificial Sequence: Synthetic polypeptide
EVQLLGSGGGLVQPGGSLRLSCAASGFTYSNYAMTWVRQAPGKGLEWVSAISGSSGSTYYADSVKGRFTISRDNSKNTLYLQMNSLRAEDTAVYYCASLCIVDPFDIWGQGTLVTVSS

SEQ ID NO: 519 - protein, 117 aa, Artificial Sequence; identical to SEQ ID NO: 498
  Description of Artificial Sequence: Synthetic polypeptide

SEQ ID NO: 520 - protein, 107 aa, Artificial Sequence
  Description of Artificial Sequence: Synthetic polypeptide
DIQMTQSPSSLSASVGDRVTITCRASQSIHRFLNWYQQKPGKAPKLLIYAASNLHSGVPSRFSGSGSGTDFTLTISSLQPEDFATYYCQQSYGLPPTFGQGTKVEIK

SEQ ID NO: 521 - protein, 108 aa, Artificial Sequence
  Description of Artificial Sequence: Synthetic polypeptide
DIQMTQSPSSLSASVGDRVTITCRASQSIHISLNWYQQKPGKAPKLLIYLASPLASGVPSRFSGSGSGTDFTLTISSLQPEDFATYYCQQSYSAPPYTFGQGTKVEIK

SEQ ID NO: 522 - protein, 108 aa, Artificial Sequence
  Description of Artificial Sequence: Synthetic polypeptide
DIQMTQSPSSLSASVGDRVTITCRASQSIHTYLNWYQQKPGKAPKLLIYAASALASGVPSRFSGSGSGTDFTLTISSLQPEDFATYYCQQSYSAPPYTFGQGTKVEIK

SEQ ID NO: 523 - protein, 106 aa, Artificial Sequence
  Description of Artificial Sequence: Synthetic polypeptide
DIQMTQSPSSLSASVGDRVTITCRASQTINTYLNWYQQKPGKAPKLLIYSASTLQSGVPSRFSGSGSGTDFTLTISSLQPEDFATYYCQQSYSTFTFGQGTKVEIK

SEQ ID NO: 524 - protein, 108 aa, Artificial Sequence
  Description of Artificial Sequence: Synthetic polypeptide
DIQMTQSPSSLSASVGDRVTITCRASQSIDTYLNWYQQKPGKAPKLLIYAASALASGVPSRFSGSGSGTDFTLTISSLQPEDFATYYCQQSYSAPPYTFGQGTKVEIK

SEQ ID NO: 525 - protein, 108 aa, Artificial Sequence; identical to SEQ ID NO: 524
  Description of Artificial Sequence: Synthetic polypeptide

SEQ ID NO: 526 - protein, 107 aa, Artificial Sequence
  Description of Artificial Sequence: Synthetic polypeptide
DIQMTQSPSSLSASVGDRVTITCRASQSIGNYLNWYQQKPGKAPKLLIYGVSSLQSGVPSRFSGSGSGTDFTLTISSLQPEDFATYYCQQSHSAPLTFGQGTKVEIK

SEQ ID NO: 527 - protein, 108 aa, Artificial Sequence
  Description of Artificial Sequence: Synthetic polypeptide
DIQMTQSPSSLSASVGDRVTITCRASQSIDNYLNWYQQKPGKAPKLLIYGVSALQSGVPSRFSGSGSGTDFTLTISSLQPEDFATYYCQQSHSAPPYFFGQGTKVEIK

SEQ ID NO: 528 - protein, 108 aa, Artificial Sequence
  Description of Artificial Sequence: Synthetic polypeptide
DIQMTQSPSSLSASVGDRVTITCRASQSIDTYLNWYQQKPGKAPKLLIYGASALESGVPSRFSGSGSGTDFTLTISSLQPEDFATYYCQQSHSAPPYFFGQGTKVEIK

SEQ ID NO: 529 - protein, 108 aa, Artificial Sequence
  Description of Artificial Sequence: Synthetic polypeptide
DIQMTQSPSSLSASVGDRVTITCRASQSIDTYLNWYQQKPGKAPKLLIYGVSALQSGVPSRFSGSGSGTDFTLTISSLQPEDFATYYCQQSYSAPPYFFGQGTKVEIK

SEQ ID NO: 530 - protein, 108 aa, Artificial Sequence; identical to SEQ ID NO: 524
  Description of Artificial Sequence: Synthetic polypeptide

SEQ ID NO: 531 - protein, 108 aa, Artificial Sequence; identical to SEQ ID NO: 524
  Description of Artificial Sequence: Synthetic polypeptide

SEQ ID NO: 532 - protein, 107 aa, Artificial Sequence
  Description of Artificial Sequence: Synthetic polypeptide
DIQMTQSPSSLSASVGDRVTITCRASQSIDNYLNWYQQKPGKAPKLLIYGVSALQSGVPSRFSGSGSGTDFTLTISSLQPEDFATYYCQQSHSAPLTFGQGTKVEIK

SEQ ID NO: 533 - protein, 107 aa, Artificial Sequence
  Description of Artificial Sequence: Synthetic polypeptide
DIQMTQSPSSLSASVGDRVTITCRASQRIGTYLNWYQQKPGKAPKLLIYAASNLEGGVPSRFSGSGSGTDFTLTISSLQPEDFATYYCQQNYSTTWTFGQGTKVEIK

SEQ ID NO: 534 - protein, 110 aa, Artificial Sequence
  Description of Artificial Sequence: Synthetic polypeptide
DIQMTQSPSSLSASVGDRVTITCTGTSSDVGSYDLVSWYQQKPGKAPKLLIYEGNKRPSGVPSRFSGSGSGTDFTLTISSLQPEDFATYYCCSYAGSSVVFGQGTKVEIK

SEQ ID NO: 535 - protein, 110 aa, Artificial Sequence
  Description of Artificial Sequence: Synthetic polypeptide
DIQMTQSPSSLSASVGDRVTITCTGTSSDVGSSNLVSWYQQKPGKAPKLLIYEGSKRPSGVPSRFSGSGSGTDFTLTISSLQPEDFATYYCCSYAGSLYVFGQGTKVEIK

SEQ ID NO: 536 - protein, 111 aa, Artificial Sequence
  Description of Artificial Sequence: Synthetic polypeptide
DIQMTQSPSSLSASVGDRVTITCTGTSSDIGSYNLVSWYQQKPGKAPKLLIYEGTKRPSGVPSRFSGSGSGTDFTLTISSLQPEDFATYYCCSYAGSRTYVFGQGTKVEIK

SEQ ID NO: 537 - protein, 112 aa, Artificial Sequence
  Description of Artificial Sequence: Synthetic polypeptide
DIQMTQSPSSLSASVGDRVTITCTGTSTDVGSYNLVSWYQQKPGKAPKLLIYEGTKRPSGVPSRFSGSGSGTDFTLTISSLQPEDFATYYCCSYAGSYTSVVFGQGTKVEIK

SEQ ID NO: 538 - protein, 112 aa, Artificial Sequence
  Description of Artificial Sequence: Synthetic polypeptide
DIQMTQSPSSLSASVGDRVTITCTGTSSNVGSYNLVSWYQQKPGKAPKLLIYEGTKRPSGVPSRFSGSGSGTDFTLTISSLQPEDFATYYCCSYAGSSSFVVFGQGTKVEIK

SEQ ID NO: 539 - protein, 108 aa, Artificial Sequence; identical to SEQ ID NO: 522
  Description of Artificial Sequence: Synthetic polypeptide

SEQ ID NO: 540 - protein, 108 aa, Artificial Sequence; identical to SEQ ID NO: 522
  Description of Artificial Sequence: Synthetic polypeptide

SEQ ID NO: 541 - protein, 106 aa, Artificial Sequence
  Description of Artificial Sequence: Synthetic polypeptide
DIQMTQSPSSLSASVGDRVTITCRASQTINTFLNWYQQKPGKAPKLLIYSASTLQSGVPSRFSGSGSGTDFTLTISSLQPEDFATYYCQQSYSTFTFGGGTKVEIK

SEQ ID NO: 542 - protein, 108 aa, Artificial Sequence
  Description of Artificial Sequence: Synthetic polypeptide
DIQMTQSPSSLSASVGDRVTITCRASQTIRTYLNWYRQKPGKAPKLLIYDASTLQRGVPSRFSGSGSGTDFTLTISSLQPEDFATYYCQQSYRTPPWTFGGGTKVEIK

SEQ ID NO: 543 - protein, 107 aa, Artificial Sequence
  Description of Artificial Sequence: Synthetic polypeptide
DIQMTQSPSSLSASVGDRVTITCRSSQSISSYLNWYQQKPGEAPKLLIYGASRLRSGVPSRFSGSGSGTDFTLTISSLQPEDFATYYCQQGYSAPWTFGGGTKVEIK

SEQ ID NO: 544 - protein, 107 aa, Artificial Sequence
  Description of Artificial Sequence: Synthetic polypeptide
DIQMTQSPSSLSASVGDRVTITCRASQSISGSLNWYQQKPGKAPKLLIYAESRLHSGVPSRFSGSGSGTDFTLTISSLQPEDFATYYCQQSYSPPQTFGGGTKVEIK

SEQ ID NO: 545 - protein, 107 aa, Artificial Sequence
  Description of Artificial Sequence: Synthetic polypeptide
DIQMTQSPSSLSASVGDRVTITCRASRSISTYLNWYQQKPGKAPKLLIYAASNLQGGVPSRLSGSGSGTDFTLTISSLQPEDFATYYCQQSHSIPRTFGGGTKVEIK

SEQ ID NO: 546 - protein, 108 aa, Artificial Sequence; identical to SEQ ID NO: 522
  Description of Artificial Sequence: Synthetic polypeptide

SEQ ID NO: 547 - protein, 9 aa, Artificial Sequence
  Description of Artificial Sequence: Synthetic peptide
FTFRSHAMS

SEQ ID NO: 548 - protein, 9 aa, Artificial Sequence
  Description of Artificial Sequence: Synthetic peptide
FTFSAYSMS

SEQ ID NO: 549 - protein, 9 aa, Artificial Sequence
  Description of Artificial Sequence: Synthetic peptide
FMFGNYAMS

SEQ ID NO: 550 - protein, 9 aa, Artificial Sequence
  Description of Artificial Sequence: Synthetic peptide
FTFRNHAMA

SEQ ID NO: 551 - protein, 9 aa, Artificial Sequence
  Description of Artificial Sequence: Synthetic peptide
FTIPNYAMS

SEQ ID NO: 552 - protein, 9 aa, Artificial Sequence
  Description of Artificial Sequence: Synthetic peptide
FTFRNYAMA

SEQ ID NO: 553 - protein, 9 aa, Artificial Sequence
  Description of Artificial Sequence: Synthetic peptide
FTIRNYAMS

SEQ ID NO: 554 - protein, 9 aa, Artificial Sequence
  Description of Artificial Sequence: Synthetic peptide
FTIPNYAMS

SEQ ID NO: 555 - protein, 9 aa, Artificial Sequence
  Description of Artificial Sequence: Synthetic peptide
FTITNYAMS

SEQ ID NO: 556 - protein, 9 aa, Artificial Sequence
  Description of Artificial Sequence: Synthetic peptide
FTFRSHAMS

SEQ ID NO: 557 - protein, 9 aa, Artificial Sequence
  Description of Artificial Sequence: Synthetic peptide
FTITNYAMS

SEQ ID NO: 558 - protein, 9 aa, Artificial Sequence
  Description of Artificial Sequence: Synthetic peptide
FTFRSHAMN

SEQ ID NO: 559 - protein, 9 aa, Artificial Sequence
  Description of Artificial Sequence: Synthetic peptide
FTFRSHAMS

SEQ ID NO: 560 - protein, 9 aa, Artificial Sequence
  Description of Artificial Sequence: Synthetic peptide
FTFRSYAMS

SEQ ID NO: 561 - protein, 9 aa, Artificial Sequence
  Description of Artificial Sequence: Synthetic peptide
FTITNYAMS

SEQ ID NO: 562 - protein, 9 aa, Artificial Sequence
  Description of Artificial Sequence: Synthetic peptide
FTFTNFAMS

SEQ ID NO: 563 - protein, 9 aa, Artificial Sequence
  Description of Artificial Sequence: Synthetic peptide
FTFRSYPMS

SEQ ID NO: 564 - protein, 9 aa, Artificial Sequence
  Description of Artificial Sequence: Synthetic peptide
FTLTSYAMS

SEQ ID NO: 565 - protein, 9 aa, Artificial Sequence
  Description of Artificial Sequence: Synthetic peptide
FTFINYAMS

SEQ ID NO: 566 - protein, 9 aa, Artificial Sequence
  Description of Artificial Sequence: Synthetic peptide
FPFSTYAMS

SEQ ID NO: 567 - protein, 9 aa, Artificial Sequence
  Description of Artificial Sequence: Synthetic peptide
FTFSTYAMG

SEQ ID NO: 568 - protein, 9 aa, Artificial Sequence
  Description of Artificial Sequence: Synthetic peptide
FIFSDYAMT

SEQ ID NO: 569 - protein, 9 aa, Artificial Sequence
  Description of Artificial Sequence: Synthetic peptide
FTFSDYAMT

SEQ ID NO: 570 - protein, 9 aa, Artificial Sequence
  Description of Artificial Sequence: Synthetic peptide
FTFSIYAMG

SEQ ID NO: 571 - protein, 9 aa, Artificial Sequence
  Description of Artificial Sequence: Synthetic peptide
FTFASYAMT

SEQ ID NO: 572 - protein, 9 aa, Artificial Sequence
  Description of Artificial Sequence: Synthetic peptide
FTFSEYAMS

SEQ ID NO: 573 - protein, 9 aa, Artificial Sequence
  Description of Artificial Sequence: Synthetic peptide
FTFDDYAMS

SEQ ID NO: 574 - protein, 9 aa, Artificial Sequence
  Description of Artificial Sequence: Synthetic peptide
FTFNNYAMN

SEQ ID NO: 575 - protein, 9 aa, Artificial Sequence
  Description of Artificial Sequence: Synthetic peptide
FTFTNHAMS

SEQ ID NO: 576 - protein, 13 aa, Artificial Sequence
  Description of Artificial Sequence: Synthetic peptide
SSISGGGASTYYA

SEQ ID NO: 577 - protein, 13 aa, Artificial Sequence
  Description of Artificial Sequence: Synthetic peptide
SAISGSGGSRYYA

SEQ ID NO: 578 - protein, 13 aa, Artificial Sequence
  Description of Artificial Sequence: Synthetic peptide
AAISGSGGSTYYA

SEQ ID NO: 579 - protein, 13 aa, Artificial Sequence
  Description of Artificial Sequence: Synthetic peptide
SGISGSGGTTYYG

SEQ ID NO: 580 - protein, 13 aa, Artificial Sequence
  Description of Artificial Sequence: Synthetic peptide
SGISGAGASTYYA

SEQ ID NO: 581 - protein, 13 aa, Artificial Sequence
  Description of Artificial Sequence: Synthetic peptide
SGISGSGGTTYYG

SEQ ID NO: 582 - protein, 13 aa, Artificial Sequence
  Description of Artificial Sequence: Synthetic peptide
SSISGGGASTYYA

SEQ ID NO: 583 - protein, 13 aa, Artificial Sequence
  Description of Artificial Sequence: Synthetic peptide
SGISGSGASTYYA

SEQ ID NO: 584 - protein, 13 aa, Artificial Sequence
  Description of Artificial Sequence: Synthetic peptide
SGISGSGAGTYYA

SEQ ID NO: 585 - protein, 13 aa, Artificial Sequence
  Description of Artificial Sequence: Synthetic peptide
SSISGGGASTYYA

SEQ ID NO: 586 - protein, 13 aa, Artificial Sequence
  Description of Artificial Sequence: Synthetic peptide
SGISGSGASTYYA

SEQ ID NO: 587 - protein, 13 aa, Artificial Sequence
  Description of Artificial Sequence: Synthetic peptide
SAISGSGGSTNYA

SEQ ID NO: 588 - protein, 13 aa, Artificial Sequence
  Description of Artificial Sequence: Synthetic peptide
SSISGGGASTYYA

SEQ ID NO: 589 - protein, 13 aa, Artificial Sequence
  Description of Artificial Sequence: Synthetic peptide
SSISGGGASTYYA

SEQ ID NO: 590 - protein, 13 aa, Artificial Sequence
  Description of Artificial Sequence: Synthetic peptide
SGISGSGAGTYYA

SEQ ID NO: 591 - protein, 13 aa, Artificial Sequence
  Description of Artificial Sequence: Synthetic peptide
SAISGRGGGTYYA

SEQ ID NO: 592 - protein, 13 aa, Artificial Sequence
  Description of Artificial Sequence: Synthetic peptide
STISGSGGITYYA

SEQ ID NO: 593 - protein, 13 aa, Artificial Sequence
  Description of Artificial Sequence: Synthetic peptide
SAISGSGVDTYYA

SEQ ID NO: 594 - protein, 13 aa, Artificial Sequence
  Description of Artificial Sequence: Synthetic peptide
STISTSGGNTYYA

SEQ ID NO: 595 - protein, 13 aa, Artificial Sequence
  Description of Artificial Sequence: Synthetic peptide
SGISVSGGFTYYA

SEQ ID NO: 596 - protein, 13 aa, Artificial Sequence
  Description of Artificial Sequence: Synthetic peptide
SGISGGGVSTYYA

SEQ ID NO: 597 - protein, 10 aa, Artificial Sequence
  Description of Artificial Sequence: Synthetic peptide
SAISGSAFYA

SEQ ID NO: 598 - protein, 13 aa, Artificial Sequence
  Description of Artificial Sequence: Synthetic peptide
SDISGSGGSTYYA

SEQ ID NO: 599 - protein, 13 aa, Artificial Sequence
  Description of Artificial Sequence: Synthetic peptide
SFISGSGGSTYYA

SEQ ID NO: 600 - protein, 13 aa, Artificial Sequence
  Description of Artificial Sequence: Synthetic peptide
SAISESGGSTYYA

SEQ ID NO: 601 - protein, 13 aa, Artificial Sequence
  Description of Artificial Sequence: Synthetic peptide
SAITGSGGSTYYG

SEQ ID NO: 602 - protein, 13 aa, Artificial Sequence
  Description of Artificial Sequence: Synthetic peptide
SGISGGGTSTYYA

SEQ ID NO: 603 - protein, 13 aa, Artificial Sequence
  Description of Artificial Sequence: Synthetic peptide
SAISGSVGSTYYA

SEQ ID NO: 604 - protein, 13 aa, Artificial Sequence
  Description of Artificial Sequence: Synthetic peptide
SAISGSGSNIYYA

SEQ ID NO: 605 - protein, 21 aa, Artificial Sequence
  Description of Artificial Sequence: Synthetic peptide
CARVKYLTTSSGWPRPYFDNW

SEQ ID NO: 606 - protein, 16 aa, Artificial Sequence
  Description of Artificial Sequence: Synthetic peptide
CGRSKWPQANGAFDIW

SEQ ID NO: 607 - protein, 18 aa, Artificial Sequence
  Description of Artificial Sequence: Synthetic peptide
CAKDRGYSSSWYGGFDYW

SEQ ID NO: 608 - protein, 17 aa, Artificial Sequence
  Description of Artificial Sequence: Synthetic peptide
CARGTRFLQWSLPLDVW

SEQ ID NO: 609 - protein, 16 aa, Artificial Sequence
  Description of Artificial Sequence: Synthetic peptide
CARHTWWKGAGFFDHW

SEQ ID NO: 610 - protein, 17 aa, Artificial Sequence
  Description of Artificial Sequence: Synthetic peptide
CARGTRFLEWSLPLDVW

SEQ ID NO: 611 - protein, 21 aa, Artificial Sequence
  Description of Artificial Sequence: Synthetic peptide
CARVKYLTTSSGWPRPYFDNW

SEQ ID NO: 612 - protein, 16 aa, Artificial Sequence
  Description of Artificial Sequence: Synthetic peptide
CARHTWWKGAGFFDHW

SEQ ID NO: 613 - protein, 16 aa, Artificial Sequence
  Description of Artificial Sequence: Synthetic peptide
CARHAWWKGAGFFDHW

SEQ ID NO: 614 - protein, 21 aa, Artificial Sequence
  Description of Artificial Sequence: Synthetic peptide
CARVKYLTTSSGWPRPYFDNW

SEQ ID NO: 615 - protein, 16 aa, Artificial Sequence
  Description of Artificial Sequence: Synthetic peptide
CARHTWWKGAGFFDHW

SEQ ID NO: 616 - protein, 18 aa, Artificial Sequence
  Description of Artificial Sequence: Synthetic peptide
CARGLKFLEWLPSAFDIW

SEQ ID NO: 617 - protein, 21 aa, Artificial Sequence
  Description of Artificial Sequence: Synthetic peptide
CARVKYLTTSSGWPRPYFDNW

SEQ ID NO: 618 - protein, 21 aa, Artificial Sequence
  Description of Artificial Sequence: Synthetic peptide
CARVKYLTTSSGWPRPYFDNW

SEQ ID NO: 619 - protein, 16 aa, Artificial Sequence
  Description of Artificial Sequence: Synthetic peptide
CARHTWWKGAGFFDHW

SEQ ID NO: 620 - protein, 18 aa, Artificial Sequence
  Description of Artificial Sequence: Synthetic peptide
CARDAHGYYYDSSGYDDW

SEQ ID NO: 621 - protein, 15 aa, Artificial Sequence
  Description of Artificial Sequence: Synthetic peptide
CAKGVYGSTVTTCHW

SEQ ID NO: 622 - protein, 12 aa, Artificial Sequence
  Description of Artificial Sequence: Synthetic peptide
CARPTNWGFDYW

SEQ ID NO: 623 - protein, 14 aa, Artificial Sequence
  Description of Artificial Sequence: Synthetic peptide
CARADSNWASSAYW

SEQ ID NO: 624 - protein, 19 aa, Artificial Sequence
  Description of Artificial Sequence: Synthetic peptide
CARDPYSYGYYYYYGMDVW

SEQ ID NO: 625 - protein, 13 aa, Artificial Sequence
  Description of Artificial Sequence: Synthetic peptide
CARARNWGPSDYW

SEQ ID NO: 626 - protein, 18 aa, Artificial Sequence
  Description of Artificial Sequence: Synthetic peptide
CARDATYSSSWYNWFDPW

SEQ ID NO: 627 - protein, 12 aa, Artificial Sequence
  Description of Artificial Sequence: Synthetic peptide
CARGTVTSFDFW

SEQ ID NO: 628 - protein, 18 aa, Artificial Sequence
  Description of Artificial Sequence: Synthetic peptide
CAKDYHSASWFSAAADYW

SEQ ID NO: 629 - protein, 18 aa, Artificial Sequence
  Description of Artificial Sequence: Synthetic peptide
CAREGQEYSSGSSYFDYW

SEQ ID NO: 630 - protein, 21 aa, Artificial Sequence
  Description of Artificial Sequence: Synthetic peptide
CARGSQTPYCGGDCPETFDYW

SEQ ID NO: 631 - protein, 16 aa, Artificial Sequence
  Description of Artificial Sequence: Synthetic peptide
CARDLYSSGWYGFDYW

SEQ ID NO: 632 - protein, 20 aa, Artificial Sequence
  Description of Artificial Sequence: Synthetic peptide
CARDNYDFWSGYYTNWFDPW

SEQ ID NO: 633 - protein, 25 aa, Artificial Sequence
  Description of Artificial Sequence: Synthetic peptide
CARDSLSVTMGRGVVTYYYYGMDFW

SEQ ID NO: 634 - protein, 11 aa, Artificial Sequence
  Description of Artificial Sequence: Synthetic peptide
RASQSIRKYLN

SEQ ID NO: 635 - protein, 11 aa, Artificial Sequence
  Description of Artificial Sequence: Synthetic peptide
RASQNIKTYLN

SEQ ID NO: 636 - protein, 11 aa, Artificial Sequence
  Description of Artificial Sequence: Synthetic peptide
RASQTIYSYLN

SEQ ID NO: 637 - protein, 11 aa, Artificial Sequence
  Description of Artificial Sequence: Synthetic peptide
RASRSIRRYLN

SEQ ID NO: 638 - protein, 11 aa, Artificial Sequence
  Description of Artificial Sequence: Synthetic peptide
RASQSIGKYLN

SEQ ID NO: 639 - protein, 11 aa, Artificial Sequence
  Description of Artificial Sequence: Synthetic peptide
RASRSISRYLN

SEQ ID NO: 640 - protein, 11 aa, Artificial Sequence
  Description of Artificial Sequence: Synthetic peptide
RASQSIGKYLN

SEQ ID NO: 641 - protein, 11 aa, Artificial Sequence
  Description of Artificial Sequence: Synthetic peptide
RASQSIGRYLN

SEQ ID NO: 642 - protein, 11 aa, Artificial Sequence
  Description of Artificial Sequence: Synthetic peptide
RASQSIGRYLN

SEQ ID NO: 643 - protein, 11 aa, Artificial Sequence
  Description of Artificial Sequence: Synthetic peptide
RASQSIGKYLN

SEQ ID NO: 644 - protein, 11 aa, Artificial Sequence
  Description of Artificial Sequence: Synthetic peptide
RASQSIGRYLN

SEQ ID NO: 645 - protein, 11 aa, Artificial Sequence
  Description of Artificial Sequence: Synthetic peptide
RTSQSINTYLN

SEQ ID NO: 646 - protein, 11 aa, Artificial Sequence
  Description of Artificial Sequence: Synthetic peptide
RASQSIGKYLN

SEQ ID NO: 647 - protein, 11 aa, Artificial Sequence
  Description of Artificial Sequence: Synthetic peptide
RASQSIGKYLN

SEQ ID NO: 648 - protein, 11 aa, Artificial Sequence
  Description of Artificial Sequence: Synthetic peptide
RASQSIGRYLN

SEQ ID NO: 649 - protein, 11 aa, Artificial Sequence
  Description of Artificial Sequence: Synthetic peptide
RASQIIGSYLN

SEQ ID NO: 650 - protein, 11 aa, Artificial Sequence
  Description of Artificial Sequence: Synthetic peptide
RASQSISRYIN

SEQ ID NO: 651 - protein, 11 aa, Artificial Sequence
  Description of Artificial Sequence: Synthetic peptide
RASQSIYTYLN

SEQ ID NO: 652 - protein, 11 aa, Artificial Sequence
  Description of Artificial Sequence: Synthetic peptide
RASQSIATYLN

SEQ ID NO: 653 - protein, 11 aa, Artificial Sequence
  Description of Artificial Sequence: Synthetic peptide
RASQNINTYLN

SEQ ID NO: 654 - protein, 11 aa, Artificial Sequence
  Description of Artificial Sequence: Synthetic peptide
RASQGIATYLN

SEQ ID NO: 655 - protein, 11 aa, Artificial Sequence
  Description of Artificial Sequence: Synthetic peptide
RASERISNYLN

SEQ ID NO: 656 - protein, 11 aa, Artificial Sequence
  Description of Artificial Sequence: Synthetic peptide
RASQSISSSLN

SEQ ID NO: 657 - protein, 11 aa, Artificial Sequence
  Description of Artificial Sequence: Synthetic peptide
RASQSISSHLN

SEQ ID NO: 658 - protein, 11 aa, Artificial Sequence
  Description of Artificial Sequence: Synthetic peptide
RASQSISSYLI

SEQ ID NO: 659 - protein, 11 aa, Artificial Sequence
  Description of Artificial Sequence: Synthetic peptide
RASPSISTYLN

SEQ ID NO: 660 - protein, 11 aa, Artificial Sequence
  Description of Artificial Sequence: Synthetic peptide
RASQNIAKYLN

SEQ ID NO: 661 - protein, 11 aa, Artificial Sequence
  Description of Artificial Sequence: Synthetic peptide
RASQSIGTYLN

SEQ ID NO: 662 - protein, 11 aa, Artificial Sequence
  Description of Artificial Sequence: Synthetic peptide
RASQSISPYLN

SEQ ID NO: 663 - protein, 7 aa, Artificial Sequence
  Description of Artificial Sequence: Synthetic peptide
ASSTLQR

SEQ ID NO: 664 - protein, 7 aa, Artificial Sequence
  Description of Artificial Sequence: Synthetic peptide
AASKLQS

SEQ ID NO: 665 - protein, 7 aa, Artificial Sequence
  Description of Artificial Sequence: Synthetic peptide
ATSTLQG

SEQ ID NO: 666 - protein, 7 aa, Artificial Sequence
  Description of Artificial Sequence: Synthetic peptide
ASSSLQA

SEQ ID NO: 667 - protein, 7 aa, Artificial Sequence
  Description of Artificial Sequence: Synthetic peptide
ASSSLQS

SEQ ID NO: 668 - protein, 7 aa, Artificial Sequence
  Description of Artificial Sequence: Synthetic peptide
AASSLQA

SEQ ID NO: 669 - protein, 7 aa, Artificial Sequence
  Description of Artificial Sequence: Synthetic peptide
ASSTLQR

SEQ ID NO: 670 - protein, 7 aa, Artificial Sequence
  Description of Artificial Sequence: Synthetic peptide
ASSSLQS

SEQ ID NO: 671 - protein, 7 aa, Artificial Sequence
  Description of Artificial Sequence: Synthetic peptide
AASSLKS

SEQ ID NO: 672 - protein, 7 aa, Artificial Sequence
  Description of Artificial Sequence: Synthetic peptide
ASSTLQR

SEQ ID NO: 673 - protein, 7 aa, Artificial Sequence
  Description of Artificial Sequence: Synthetic peptide
AASSLKS

SEQ ID NO: 674 - protein, 7 aa, Artificial Sequence
  Description of Artificial Sequence: Synthetic peptide
GASNVQS

SEQ ID NO: 675 - protein, 7 aa, Artificial Sequence
  Description of Artificial Sequence: Synthetic peptide
ASSTLQR

SEQ ID NO: 676 - protein, 7 aa, Artificial Sequence
  Description of Artificial Sequence: Synthetic peptide
ASSTLQR

SEQ ID NO: 677 - protein, 7 aa, Artificial Sequence
  Description of Artificial Sequence: Synthetic peptide
AASSLKS

SEQ ID NO: 678 - protein, 7 aa, Artificial Sequence
  Description of Artificial Sequence: Synthetic peptide
TTSNLQS

SEQ ID NO: 679 - protein, 7 aa, Artificial Sequence
  Description of Artificial Sequence: Synthetic peptide
EASSLES

SEQ ID NO: 680 - protein, 7 aa, Artificial Sequence
  Description of Artificial Sequence: Synthetic peptide
SASNLHS

SEQ ID NO: 681 - protein, 7 aa, Artificial Sequence
  Description of Artificial Sequence: Synthetic peptide
GASSLEG

SEQ ID NO: 682 - protein, 7 aa, Artificial Sequence
  Description of Artificial Sequence: Synthetic peptide
SASSLQS

SEQ ID NO: 683 - protein, 7 aa, Artificial Sequence
  Description of Artificial Sequence: Synthetic peptide
YASNLQS

SEQ ID NO: 684 - protein, 7 aa, Artificial Sequence
  Description of Artificial Sequence: Synthetic peptide
TASNLES

SEQ ID NO: 685 - protein, 7 aa, Artificial Sequence
  Description of Artificial Sequence: Synthetic peptide
AASRLQD

SEQ ID NO: 686 - protein, 7 aa, Artificial Sequence
  Description of Artificial Sequence: Synthetic peptide
RASTLQS

SEQ ID NO: 687 - protein, 7 aa, Artificial Sequence
  Description of Artificial Sequence: Synthetic peptide
AASRLHS

SEQ ID NO: 688 - protein, 7 aa, Artificial Sequence
  Description of Artificial Sequence: Synthetic peptide
TASRLQT

SEQ ID NO: 689 - protein, 7 aa, Artificial Sequence
  Description of Artificial Sequence: Synthetic peptide
GASGLQS

SEQ ID NO: 690 - protein, 7 aa, Artificial Sequence
  Description of Artificial Sequence: Synthetic peptide
AASNLHS

SEQ ID NO: 691 - protein, 7 aa, Artificial Sequence
  Description of Artificial Sequence: Synthetic peptide
KASSLQS

SEQ ID NO: 692 - protein, 11 aa, Artificial Sequence [sequence omitted]

SEQ ID NO: 693 - protein, 11 aa, Artificial Sequence [sequence omitted]

SEQ ID NO: 694 - protein, 7 aa, Artificial Sequence [sequence omitted]

SEQ ID NO: 695 - protein, 11 aa, Artificial Sequence [sequence omitted]

SEQ ID NO: 696 - protein, 11 aa, Artificial Sequence [sequence omitted]

SEQ ID NO: 697 - protein, 11 aa, Artificial Sequence [sequence omitted]

SEQ ID NO: 698 - protein, 11 aa, Artificial Sequence
  Description of Artificial Sequence: Synthetic peptide
CQQSLSPPFTF

SEQ ID NO: 699 - protein, 11 aa, Artificial Sequence [sequence omitted]

SEQ ID NO: 700 - protein, 11 aa, Artificial Sequence [sequence omitted]

SEQ ID NO: 701 - protein, 11 aa, Artificial Sequence [sequence omitted]

SEQ ID NO: 702 - protein, 11 aa, Artificial Sequence [sequence omitted]

SEQ ID NO: 703 - protein, 11 aa, Artificial Sequence [sequence omitted]

SEQ ID NO: 704 - protein, 11 aa, Artificial Sequence
  Description of Artificial Sequence: Synthetic peptide
CQQSFSPPFTF

SEQ ID NO: 705 - protein, 11 aa, Artificial Sequence [sequence omitted]

SEQ ID NO: 706 - protein, 11 aa, Artificial Sequence [sequence omitted]

SEQ ID NO: 707 - protein, 11 aa, Artificial Sequence [sequence omitted]

SEQ ID NO: 708 - protein, 11 aa, Artificial Sequence [sequence omitted]

SEQ ID NO: 709 - protein, 11 aa, Artificial Sequence [sequence omitted]

SEQ ID NO: 710 - protein, 11 aa, Artificial Sequence
  Description of Artificial Sequence: Synthetic peptide
CQQTFSSPFTF

SEQ ID NO: 711 - protein, 11 aa, Artificial Sequence
  Description of Artificial Sequence: Synthetic peptide
CQQSSLTPWTF

SEQ ID NO: 712 - protein, 11 aa, Artificial Sequence [sequence omitted]

SEQ ID NO: 713 - protein, 11 aa, Artificial Sequence [sequence omitted]

SEQ ID NO: 714 - protein, 11 aa, Artificial Sequence [sequence omitted]

SEQ ID NO: 715 - protein, 11 aa, Artificial Sequence [sequence omitted]

SEQ ID NO: 716 - protein, 11 aa, Artificial Sequence
  Description of Artificial Sequence: Synthetic peptide
CQQGYNTPRTF

SEQ ID NO: 717 - protein, 11 aa, Artificial Sequence
  Description of Artificial Sequence: Synthetic peptide
CQQTYSTPSSF

SEQ ID NO: 718 - protein, 11 aa, Artificial Sequence
  Description of Artificial Sequence: Synthetic peptide
CQQSHSPPITF

SEQ ID NO: 719 - protein, 11 aa, Artificial Sequence
  Description of Artificial Sequence: Synthetic peptide
CQESYSAPYTF

SEQ ID NO: 720 - protein, 11 aa, Artificial Sequence [sequence omitted]

SEQ ID NO: 721 - protein, 126 aa, Artificial Sequence
  Description of Artificial Sequence: Synthetic polypeptide
EVQLLESGGGLVQPGGSLRLSCAASGFTFRSHAMSWVRQAPGKGLEWVSSISGGGASTYYADSVKGRFTISRDNSKNTLYLQMNSLRAEDTAVYYCARVKYLTTSSGWPRPYFDNWGQGTLVTVSS

SEQ ID NO: 722 - protein, 121 aa, Artificial Sequence
  Description of Artificial Sequence: Synthetic polypeptide
EVQLLESGGGLVQPGGSLRLSCAASGFTFSAYSMSWVRQAPGKGLEWVSAISGSGGSRYYADSVKGRFTISRDNSKNTLYLQMNSLRAEDTAVYYCGRSKWPQANGAFDIWGQGTLVTVSS

SEQ ID NO: 723 - protein, 123 aa, Artificial Sequence
  Description of Artificial Sequence: Synthetic polypeptide
EVQLLESGGGLVQPGGSLRLSCAASGFMFGNYAMSWVRQAPGKGLEWVAAISGSGGSTYYADSVKGRFTISRDNSKNTLYLQMNSLRAEDTAVYYCAKDRGYSSSWYGGFDYWGQGTLVTVSS

SEQ ID NO: 724 - protein, 122 aa, Artificial Sequence
  Description of Artificial Sequence: Synthetic polypeptide
EVQLLESGGGLVQPGGSLRLSCAASGFTFRNHAMAWVRQAPGKGLEWVSGISGSGGTTYYGDSVKGRFTISRDNSKNTLYLQMNSLRAEDTAVYYCARGTRFLQWSLPLDVWGQGTLVTVSS

SEQ ID NO: 725 - protein, 121 aa, Artificial Sequence
  Description of Artificial Sequence: Synthetic polypeptide
EVQLLESGGGLVQPGGSLRLSCAASGFTIPNYAMSWVRQAPGKGLEWVSGISGAGASTYYADSVKGRFTISRDNSKNTLYLQMNSLRAEDTAVYYCARHTWWKGAGFFDHWGQGTLVTVSS

SEQ ID NO: 726 - protein, 122 aa, Artificial Sequence
  Description of Artificial Sequence: Synthetic polypeptide
EVQLLESGGGLVQPGGSLRLSCAASGFTFRNYAMAWVRQAPGKGLEWVSGISGSGGTTYYGDSVKGRFTISRDNSKNTLYLQMNSLRAEDTAVYYCARGTRFLEWSLPLDVWGQGTLVTVSS

SEQ ID NO: 727 - protein, 126 aa, Artificial Sequence
  Description of Artificial Sequence: Synthetic polypeptide
EVQLLESGGGLVQPGGSLRLSCAASGFTIRNYAMSWVRQAPGKGLEWVSSISGGGASTYYADSVKGRFTISRDNSKNTLYLQMNSLRAEDTAVYYCARVKYLTTSSGWPRPYFDNWGQGTLVTVSS

SEQ ID NO: 728 - protein, 121 aa, Artificial Sequence
  Description of Artificial Sequence: Synthetic polypeptide
EVQLLESGGGLVQPGGSLRLSCAASGFTIPNYAMSWVRQAPGKGLEWVSGISGSGASTYYADSVKGRFTISRDNSKNTLYLQMNSLRAEDTAVYYCARHTWWKGAGFFDHWGQGTLVTVSS

SEQ ID NO: 729 - protein, 121 aa, Artificial Sequence
  Description of Artificial Sequence: Synthetic polypeptide
EVQLLESGGGLVQPGGSLRLSCAASGFTITNYAMSWVRQAPGKGLEWVSGISGSGAGTYYADSVKGRFTISRDNSKNTLYLQMNSLRAEDTAVYYCARHAWWKGAGFFDHWGQGTLVTVSS

SEQ ID NO: 730 - protein, 126 aa, Artificial Sequence; identical to SEQ ID NO: 721
  Description of Artificial Sequence: Synthetic polypeptide

SEQ ID NO: 731 - protein, 121 aa, Artificial Sequence
  Description of Artificial Sequence: Synthetic polypeptide
EVQLLESGGGLVQPGGSLRLSCAASGFTITNYAMSWVRQAPGKGLEWVSGISGSGASTYYADSVKGRFTISRDNSKNTLYLQMNSLRAEDTAVYYCARHTWWKGAGFFDHWGQGTLVTVSS

SEQ ID NO: 732 - protein, 123 aa, Artificial Sequence
  Description of Artificial Sequence: Synthetic polypeptide
EVQLLESGGGLVQPGGSLRLSCAASGFTFRSHAMNWVRQAPGKGLEWVSAISGSGGSTNYADSVKGRFTISRDNSKNTLYLQMNSLRAEDTAVYYCARGLKFLEWLPSAFDIWGQGTLVTVSS

SEQ ID NO: 733 - protein, 126 aa, Artificial Sequence; identical to SEQ ID NO: 721
  Description of Artificial Sequence: Synthetic polypeptide

SEQ ID NO: 734 - protein, 126 aa, Artificial Sequence
  Description of Artificial Sequence: Synthetic polypeptide
EVQLLESGGGLVQPGGSLRLSCAASGFTFRSYAMSWVRQAPGKGLEWVSSISGGGASTYYADSVKGRFTISRDNSKNTLYLQMNSLRAEDTAVYYCARVKYLTTSSGWPRPYFDNWGQGTLVTVSS

SEQ ID NO: 735 - protein, 121 aa, Artificial Sequence
  Description of Artificial Sequence: Synthetic polypeptide
EVQLLESGGGLVQPGGSLRLSCAASGFTITNYAMSWVRQAPGKGLEWVSGISGSGAGTYYADSVKGRFTISRDNSKNTLYLQMNSLRAEDTAVYYCARHTWWKGAGFFDHWGQGTLVTVSS

SEQ ID NO: 736 - protein, 123 aa, Artificial Sequence
  Description of Artificial Sequence: Synthetic polypeptide
EVQLLESGGGLVQPGGSLRLSCAASGFTFTNFAMSWVRQAPGKGLEWVSAISGRGGGTYYADSVKGRFTISRDNSKNTLYLQMNSLRAEDTAVYYCARDAHGYYYDSSGYDDWGQGTLVTVSS

SEQ ID NO: 737 - protein, 120 aa, Artificial Sequence
  Description of Artificial Sequence: Synthetic polypeptide
EVQLLESGGGLVQPGGSLRLSCAASGFTFRSYPMSWVRQAPGKGLEWVSTISGSGGITYYADSVKGRFTISRDNSKNTLYLQMNSLRAEDTAVYYCAKGVYGSTVTTCHWGQGTLVTVSS

SEQ ID NO: 738 - protein, 117 aa, Artificial Sequence
  Description of Artificial Sequence: Synthetic polypeptide
EVQLLESGGGLVQPGGSLRLSCAASGFTLTSYAMSWVRQAPGKGLEWVSAISGSGVDTYYADSVKGRFTISRDNSKNTLYLQMNSLRAEDTAVYYCARPTNWGFDYWGQGTLVTVSS

SEQ ID NO: 739 - protein, 119 aa, Artificial Sequence
  Description of Artificial Sequence: Synthetic polypeptide
EVQLLESGGGLVQPGGSLRLSCAASGFTFINYAMSWVRQAPGKGLEWVSTISTSGGNTYYADSVKGRFTISRDNSKNTLYLQMNSLRAEDTAVYYCARADSNWASSAYWGQGTLVTVSS

SEQ ID NO: 740 - protein, 124 aa, Artificial Sequence
  Description of Artificial Sequence: Synthetic polypeptide
EVQLLESGGGLVQPGGSLRLSCAASGFPFSTYAMSWVRQAPGKGLEWVSGISVSGGFTYYADSVKGRFTISRDNSKNTLYLQMNSLRAEDTAVYYCARDPYSYGYYYYYGMDVWGQGTLVTVSS

SEQ ID NO: 741 - protein, 118 aa, Artificial Sequence
  Description of Artificial Sequence: Synthetic polypeptide
EVQLLESGGGLVQPGGSLRLSCAASGFTFSTYAMGWVRQAPGKGLEWVSGISGGGVSTYYADSVKGRFTISRDNSKNTLYLQMNSLRAEDTAVYYCARARNWGPSDYWGQGTLVTVSS

SEQ ID NO: 742 - protein, 120 aa, Artificial Sequence
  Description of Artificial Sequence: Synthetic polypeptide
EVQLLESGGGLVQPGGSLRLSCAASGFIFSDYAMTWVRQAPGKGLEWVSAISGSAFYADSVKGRFTISRDNSKNTLYLQMNSLRAEDTAVYYCARDATYSSSWYNWFDPWGQGTLVTVSS

SEQ ID NO: 743 - protein, 117 aa, Artificial Sequence
  Description of Artificial Sequence: Synthetic polypeptide
EVQLLESGGGLVQPGGSLRLSCAASGFTFSDYAMTWVRQAPGKGLEWVSDISGSGGSTYYADSVKGRFTISRDNSKNTLYLQMNSLRAEDTAVYYCARGTVTSFDFWGQGTLVTVSS

SEQ ID NO: 744 - protein, 123 aa, Artificial Sequence
  Description of Artificial Sequence: Synthetic polypeptide
EVQLLESGGGLVQPGGSLRLSCAASGFTFSIYAMGWVRQAPGKGLEWVSFISGSGGSTYYADSVKGRFTISRDNSKNTLYLQMNSLRAEDTAVYYCAKDYHSASWFSAAADYWGQGTLVTVSS

SEQ ID NO: 745 - protein, 123 aa, Artificial Sequence
  Description of Artificial Sequence: Synthetic polypeptide
EVQLLESGGGLVQPGGSLRLSCAASGFTFASYAMTWVRQAPGKGLEWVSAISESGGSTYYADSVKGRFTISRDNSKNTLYLQMNSLRAEDTAVYYCAREGQEYSSGSSYFDYWGQGTLVTVSS

SEQ ID NO: 746 - protein, 126 aa, Artificial Sequence
  Description of Artificial Sequence: Synthetic polypeptide
EVQLLESGGGLVQPGGSLRLSCAASGFTFSEYAMSWVRQAPGKGLEWVSAITGSGGSTYYGDSVKGRFTISRDNSKNTLYLQMNSLRAEDTAVYYCARGSQTPYCGGDCPETFDYWGQGTLVTVSS

SEQ ID NO: 747 - protein, 121 aa, Artificial Sequence
  Description of Artificial Sequence: Synthetic polypeptide
EVQLLESGGGLVQPGGSLRLSCAASGFTFDDYAMSWVRQAPGKGLEWVSGISGGGTSTYYADSVKGRFTISRDNSKNTLYLQMNSLRAEDTAVYYCARDLYSSGWYGFDYWGQGTLVTVSS

SEQ ID NO: 748 - protein, 125 aa, Artificial Sequence
  Description of Artificial Sequence: Synthetic polypeptide
EVQLLESGGGLVQPGGSLRLSCAASGFTFNNYAMNWVRQAPGKGLEWVSAISGSVGSTYYADSVKGRFTISRDNSKNTLYLQMNSLRAEDTAVYYCARDNYDFWSGYYTNWFDPWGQGTLVTVSS

SEQ ID NO: 749 - protein, 130 aa, Artificial Sequence
  Description of Artificial Sequence: Synthetic polypeptide
EVQLLESGGGLVQPGGSLRLSCAASGFTFTNHAMSWVRQAPGKGLEWVSAISGSGSNIYYADSVKGRFTISRDNSKNTLYLQMNSLRAEDTAVYYCARDSLSVTMGRGVVTYYYYGMDFWGQGTLVTVSS

SEQ ID NO: 750 - protein, 107 aa, Artificial Sequence
  Description of Artificial Sequence: Synthetic polypeptide
DIQMTQSPSSLSASVGDRVTITCRASQSIRKYLNWYQQKPGKAPKLLIYASSTLQRGVPSRFSGSGSGTDFTLTISSLQPEDFATYYCQQSLSTPFTFGGGTKVEIK

SEQ ID NO: 751 - protein, 107 aa, Artificial Sequence
  Description of Artificial Sequence: Synthetic polypeptide
DIQMTQSPSSLSASVGDRVTITCRASRSIRRYLNWYQQKPGKAPKLLIYASSSLQAGVPSRFSGSGSGTDFTLTISSLQPEDFATYYCQQSYSTLLTFGQGTKVEIK

SEQ ID NO: 752 - protein, 107 aa, Artificial Sequence
  Description of Artificial Sequence: Synthetic polypeptide
DIQMTQSPSSLSASVGDRVTITCRASQSIGRYLNWYQQKPGKAPKLLIYASSSLQSGVPSRFSGSGSGTDFTLTISSLQPEDFATYYCQQSYSLPRTFGQGTKVEIK

SEQ ID NO: 753 - protein, 103 aa, Artificial Sequence
  Description of Artificial Sequence: Synthetic polypeptide
DIQMTQSPSSLSASVGDRVTITCRASQTIYSYLNWYQQKPGKAPKLLIYATSTLQGGVPSRFSGSGSGTDFTLTISSLQPEDFATYYCQHRGTFGQGTKVEIK

SEQ ID NO: 754 - protein, 107 aa, Artificial Sequence
  Description of Artificial Sequence: Synthetic polypeptide
DIQMTQSPSSLSASVGDRVTITCRASQSIGRYLNWYQQKPGKAPKLLIYAASSLKSGVPSRFSGSGSGTDFTLTISSLQPEDFATYYCQQSYSLPRTFGQGTKVEIK

SEQ ID NO: 755 - protein, 107 aa, Artificial Sequence
  Description of Artificial Sequence: Synthetic polypeptide
DIQMTQSPSSLSASVGDRVTITCRASQSIGKYLNWYQQKPGKAPKLLIYASSSLQSGVPSRFSGSGSGTDFTLTISSLQPEDFATYYCQQSYSPPFTFGQGTKVEIK

SEQ ID NO: 756 - protein, 107 aa, Artificial Sequence
  Description of Artificial Sequence: Synthetic polypeptide
DIQMTQSPSSLSASVGDRVTITCRASQNIKTYLNWYQQKPGKAPKLLIYAASKLQSGVPSRFSGSGSGTDFTLTISSLQPEDFATYYCQQSYSTSPTFGQGTKVEIK

SEQ ID NO: 757 - protein, 107 aa, Artificial Sequence
  Description of Artificial Sequence: Synthetic polypeptide
DIQMTQSPSSLSASVGDRVTITCRASRSISRYLNWYQQKPGKAPKLLIYAASSLQAGVPSRFSGSGSGTDFTLTISSLQPEDFATYYCQQSYSSLLTFGQGTKVEIK

SEQ ID NO: 758 - protein, 107 aa, Artificial Sequence
  Description of Artificial Sequence: Synthetic polypeptide
DIQMTQSPSSLSASVGDRVTITCRASQSIGKYLNWYQQKPGKAPKLLIYASSTLQRGVPSRFSGSGSGTDFTLTISSLQPEDFATYYCQQSLSPPFTFGQGTKVEIK

SEQ ID NO: 759 - protein, 107 aa, Artificial Sequence
  Description of Artificial Sequence: Synthetic polypeptide
DIQMTQSPSSLSASVGDRVTITCRASQSIGRYLNWYQQKPGKAPKLLIYAASSLKSGVPSRFSGSGSGTDFTLTISSLQPEDFATYYCQQSYSLPLTFGQGTKVEIK

SEQ ID NO: 760 - protein, 107 aa, Artificial Sequence
  Description of Artificial Sequence: Synthetic polypeptide
DIQMTQSPSSLSASVGDRVTITCRTSQSINTYLNWYQQKPGKAPKLLIYGASNVQSGVPSRFSGSGSGTDFTLTISSLQPEDFATYYCQQSYRIPRTFGQGTKVEIK

SEQ ID NO: 761 - protein, 107 aa, Artificial Sequence
  Description of Artificial Sequence: Synthetic polypeptide
DIQMTQSPSSLSASVGDRVTITCRASQSIGKYLNWYQQKPGKAPKLLIYASSTLQRGVPSRFSGSGSGTDFTLTISSLQPEDFATYYCQQSLSTPFTFGQGTKVEIK

SEQ ID NO: 762 - protein, 107 aa, Artificial Sequence
  Description of Artificial Sequence: Synthetic polypeptide
DIQMTQSPSSLSASVGDRVTITCRASQSIGKYLNWYQQKPGKAPKLLIYASSTLQRGVPSRFSGSGSGTDFTLTISSLQPEDFATYYCQQSFSTPFTFGQGTKVEIK

SEQ ID NO: 763 - protein, 107 aa, Artificial Sequence; identical to SEQ ID NO: 754
  Description of Artificial Sequence: Synthetic polypeptide

SEQ ID NO: 764 - protein, 107 aa, Artificial Sequence
  Description of Artificial Sequence: Synthetic polypeptide
DIQMTQSPSSLSASVGDRVTITCRASQSIGKYLNWYQQKPGKAPKLLIYASSTLQRGVPSRFSGSGSGTDFTLTISSLQPEDFATYYCQQSFSPPFTFGQGTKVEIK

SEQ ID NO: 765 - protein, 107 aa, Artificial Sequence
  Description of Artificial Sequence: Synthetic polypeptide
DIQMTQSPSSLSASVGDRVTITCRASQIIGSYLNWYQQKPGKAPKLLIYTTSNLQSGVPSRFSGSGSGTDFTLTISSLQPEDFATYYCQQSYITPWTFGQGTKVEIK

SEQ ID NO: 766 - protein, 107 aa, Artificial Sequence
  Description of Artificial Sequence: Synthetic polypeptide
DIQMTQSPSSLSASVGDRVTITCRASQSISRYINWYQQKPGKAPKLLIYEASSLESGVPSRFSGSGSGTDFTLTISSLQPEDFATYYCQQSHITPLTFGQGTKVEIK

SEQ ID NO: 767 - protein, 107 aa, Artificial Sequence
  Description of Artificial Sequence: Synthetic polypeptide
DIQMTQSPSSLSASVGDRVTITCRASQSIYTYLNWYQQKPGKAPKLLIYSASNLHSGVPSRFSGSGSGTDFTLTISSLQPEDFATYYCQQSDTTPWTFGQGTKVEIK

SEQ ID NO: 768 - protein, 107 aa, Artificial Sequence
  Description of Artificial Sequence: Synthetic polypeptide
DIQMTQSPSSLSASVGDRVTITCRASQSIATYLNWYQQKPGKAPKLLIYGASSLEGGVPSRFSGSGSGTDFTLTISSLQPEDFATYYCQQTFSSPFTFGQGTKVEIK

SEQ ID NO: 769 - protein, 107 aa, Artificial Sequence
  Description of Artificial Sequence: Synthetic polypeptide
DIQMTQSPSSLSASVGDRVTITCRASQNINTYLNWYQQKPGKAPKLLIYSASSLQSGVPSRFSGSGSGTDFTLTISSLQPEDFATYYCQQSSLTPWTFGQGTKVEIK

SEQ ID NO: 770 - protein, 107 aa, Artificial Sequence
  Description of Artificial Sequence: Synthetic polypeptide
DIQMTQSPSSLSASVGDRVTITCRASQGIATYLNWYQQKPGKAPKLLIYYASNLQSGVPSRFSGSGSGTDFTLTISSLQPEDFATYYCQQSYSTRFTFGQGTKVEIK

SEQ ID NO: 771 - protein, 107 aa, Artificial Sequence
  Description of Artificial Sequence: Synthetic polypeptide
DIQMTQSPSSLSASVGDRVTITCRASERISNYLNWYQQKPGKAPKLLIYTASNLESGVPSRFSGSGSGTDFTLTISSLQPEDFATYYCQQSYTPPRTFGQGTKVEIK

SEQ ID NO: 772 - protein, 107 aa, Artificial Sequence
  Description of Artificial Sequence: Synthetic polypeptide
DIQMTQSPSSLSASVGDRVTITCRASQSISSSLNWYQQKPGKAPKLLIYAASRLQDGVPSRFSGSGSGTDFTLTISSLQPEDFATYYCQQSYSTPRSFGQGTKVEIK

SEQ ID NO: 773 - protein, 107 aa, Artificial Sequence
  Description of Artificial Sequence: Synthetic polypeptide
DIQMTQSPSSLSASVGDRVTITCRASQSISSHLNWYQQKPGKAPKLLIYRASTLQSGVPSRFSGSGSGTDFTLTISSLQPEDFATYYCQQTYNTPQTFGQGTKVEIK

SEQ ID NO: 774 - protein, 107 aa, Artificial Sequence
  Description of Artificial Sequence: Synthetic polypeptide
DIQMTQSPSSLSASVGDRVTITCRASQSISSYLIWYQQKPGKAPKLLIYAASRLHSGVPSRFSGSGSGTDFTLTISSLQPEDFATYYCQQGYNTPRTFGQGTKVEIK

SEQ ID NO: 775 - protein, 107 aa, Artificial Sequence
  Description of Artificial Sequence: Synthetic polypeptide
DIQMTQSPSSLSASVGDRVTITCRASPSISTYLNWYQQKPGKAPKLLIYTASRLQTGVPSRFSGSGSGTDFTLTISSLQPEDFATYYCQQTYSTPSSFGQGTKVEIK

SEQ ID NO: 776 - protein, 107 aa, Artificial Sequence
  Description of Artificial Sequence: Synthetic polypeptide
DIQMTQSPSSLSASVGDRVTITCRASQNIAKYLNWYQQKPGKAPKLLIYGASGLQSGVPSRFSGSGSGTDFTLTISSLQPEDFATYYCQQSHSPPITFGQGTKVEIK

SEQ ID NO: 777 - protein, 107 aa, Artificial Sequence
  Description of Artificial Sequence: Synthetic polypeptide
DIQMTQSPSSLSASVGDRVTITCRASQSIGTYLNWYQQKPGKAPKLLIYAASNLHSGVPSRFSGSGSGTDFTLTISSLQPEDFATYYCQESYSAPYTFGQGTKVEIK

SEQ ID NO: 778 - protein, 107 aa, Artificial Sequence
  Description of Artificial Sequence: Synthetic polypeptide
DIQMTQSPSSLSASVGDRVTITCRASQSISPYLNWYQQKPGKAPKLLIYKASSLQSGVPSRFSGSGSGTDFTLTISSLQPEDFATYYCQQSSSTPYTFGQGTKVEIK

SEQ ID NO: 779 - protein, 7 aa, Artificial Sequence
  Description of Artificial Sequence: Synthetic peptide
PGTAIMG

SEQ ID NO: 780 - protein, 9 aa, Artificial Sequence
  Description of Artificial Sequence: Synthetic peptide
RSFSNSVMG

SEQ ID NO: 781 - protein, 9 aa, Artificial Sequence
  Description of Artificial Sequence: Synthetic peptide
RTFGDDTMG

SEQ ID NO: 782 - protein, 9 aa, Artificial Sequence
  Description of Artificial Sequence: Synthetic peptide
RTFSDARMG

SEQ ID NO: 783 - protein, 9 aa, Artificial Sequence
  Description of Artificial Sequence: Synthetic peptide
RTFGDYIMG

SEQ ID NO: 784 - protein, 9 aa, Artificial Sequence
  Description of Artificial Sequence: Synthetic peptide
SGLSINAMG

SEQ ID NO: 785 - protein, 9 aa, Artificial Sequence
  Description of Artificial Sequence: Synthetic peptide
RTFSNAAMG

SEQ ID NO: 786 - protein, 9 aa, Artificial Sequence
  Description of Artificial Sequence: Synthetic peptide
FSLDYYGMG

SEQ ID NO: 787 - protein, 9 aa, Artificial Sequence
  Description of Artificial Sequence: Synthetic peptide
FTFSRHDMG

SEQ ID NO: 788 - protein, 9 aa, Artificial Sequence
  Description of Artificial Sequence: Synthetic peptide
LTFRNYAMG

SEQ ID NO: 789 - protein, 9 aa, Artificial Sequence
  Description of Artificial Sequence: Synthetic peptide
GTFSRYAMG

SEQ ID NO: 790 - protein, 9 aa, Artificial Sequence
  Description of Artificial Sequence: Synthetic peptide
FTLDYYDMG

SEQ ID NO: 791 - protein, 9 aa, Artificial Sequence
  Description of Artificial Sequence: Synthetic peptide
RTFGDYIMG

SEQ ID NO: 792 - protein, 9 aa, Artificial Sequence
  Description of Artificial Sequence: Synthetic peptide
RTFGDDIMG

SEQ ID NO: 793 - protein, 9 aa, Artificial Sequence
  Description of Artificial Sequence: Synthetic peptide
RTFGDYIMG

SEQ ID NO: 794 - protein, 9 aa, Artificial Sequence
  Description of Artificial Sequence: Synthetic peptide
RTFGDYIMG

SEQ ID NO: 795 - protein, 9 aa, Artificial Sequence
  Description of Artificial Sequence: Synthetic peptide
RTFSDDTMG

SEQ ID NO: 796 - protein, 9 aa, Artificial Sequence
  Description of Artificial Sequence: Synthetic peptide
RTFGDDTMG

SEQ ID NO: 797 - protein, 9 aa, Artificial Sequence
  Description of Artificial Sequence: Synthetic peptide
RTFGDYIMG

SEQ ID NO: 798 - protein, 9 aa, Artificial Sequence
  Description of Artificial Sequence: Synthetic peptide
RTFGDDTMG

SEQ ID NO: 799 - protein, 9 aa, Artificial Sequence
  Description of Artificial Sequence: Synthetic peptide
RTFSDYTMG

SEQ ID NO: 800 - protein, 9 aa, Artificial Sequence
  Description of Artificial Sequence: Synthetic peptide
RTFGDYGMG

SEQ ID NO: 801 - protein, 9 aa, Artificial Sequence
  Description of Artificial Sequence: Synthetic peptide
RTFSDDTMG

SEQ ID NO: 802 - protein, 9 aa, Artificial Sequence
  Description of Artificial Sequence: Synthetic peptide
RTFSDDIMG

SEQ ID NO: 803 - protein, 9 aa, Artificial Sequence
  Description of Artificial Sequence: Synthetic peptide
RTFGDYIMG

SEQ ID NO: 804 - protein, 10 aa, Artificial Sequence
  Description of Artificial Sequence: Synthetic peptide
FTFDDDYVMG

SEQ ID NO: 805 - protein, 9 aa, Artificial Sequence
  Description of Artificial Sequence: Synthetic peptide
RTFGDYIMG

SEQ ID NO: 806 - protein, 9 aa, Artificial Sequence
  Description of Artificial Sequence: Synthetic peptide
RTFGDYIMG

SEQ ID NO: 807 - protein, 9 aa, Artificial Sequence
  Description of Artificial Sequence: Synthetic peptide
RTFGDDTMG

SEQ ID NO: 808 - protein, 9 aa, Artificial Sequence
  Description of Artificial Sequence: Synthetic peptide
RTFSDDTMG

SEQ ID NO: 809 - protein, 9 aa, Artificial Sequence
  Description of Artificial Sequence: Synthetic peptide
RTFSDDTMG

SEQ ID NO: 810 - protein, 9 aa, Artificial Sequence
  Description of Artificial Sequence: Synthetic peptide
RTFSDDTMG

SEQ ID NO: 811 - protein, 9 aa, Artificial Sequence
  Description of Artificial Sequence: Synthetic peptide
RTFSDDAMG

SEQ ID NO: 812 - protein, 9 aa, Artificial Sequence
  Description of Artificial Sequence: Synthetic peptide
RTFSDDTMG

SEQ ID NO: 813 - protein, 9 aa, Artificial Sequence
  Description of Artificial Sequence: Synthetic peptide
RTFGDYIMG

SEQ ID NO: 814 - protein, 9 aa, Artificial Sequence
  Description of Artificial Sequence: Synthetic peptide
RTFGDDTMG

SEQ ID NO: 815 - protein, 9 aa, Artificial Sequence
  Description of Artificial Sequence: Synthetic peptide
RTFSDDAMG

SEQ ID NO: 816 - protein, 9 aa, Artificial Sequence
  Description of Artificial Sequence: Synthetic peptide
RTFGDYIMG

SEQ ID NO: 817 - protein, 9 aa, Artificial Sequence
  Description of Artificial Sequence: Synthetic peptide
RTFSDDTMG

SEQ ID NO: 818 - protein, 9 aa, Artificial Sequence
  Description of Artificial Sequence: Synthetic peptide
RTFSDDAMG

SEQ ID NO: 819 - protein, 9 aa, Artificial Sequence
  Description of Artificial Sequence: Synthetic peptide
FTFDDYEMG

SEQ ID NO: 820 - protein, 9 aa, Artificial Sequence
  Description of Artificial Sequence: Synthetic peptide
RTFGDDTMG

SEQ ID NO: 821 - protein, 9 aa, Artificial Sequence
  Description of Artificial Sequence: Synthetic peptide
RTFSDDAMG

SEQ ID NO: 822 - protein, 9 aa, Artificial Sequence
  Description of Artificial Sequence: Synthetic peptide
VTLDDYAMG

SEQ ID NO: 823 - protein, 9 aa, Artificial Sequence
  Description of Artificial Sequence: Synthetic peptide
RTFGDYIMG

SEQ ID NO: 824 - protein, 9 aa, Artificial Sequence
  Description of Artificial Sequence: Synthetic peptide
LTFSDDTMG

SEQ ID NO: 825 - protein, 9 aa, Artificial Sequence
  Description of Artificial Sequence: Synthetic peptide
RTFGDDTMG

SEQ ID NO: 826 - protein, 9 aa, Artificial Sequence
  Description of Artificial Sequence: Synthetic peptide
RTFGDYIMG

SEQ ID NO: 827 - protein, 9 aa, Artificial Sequence
  Description of Artificial Sequence: Synthetic peptide
RTFGDDTMG

SEQ ID NO: 828 - protein, 9 aa, Artificial Sequence
  Description of Artificial Sequence: Synthetic peptide
RTFGDYTMG

SEQ ID NO: 829 - protein, 9 aa, Artificial Sequence
  Description of Artificial Sequence: Synthetic peptide
RTFSDDTMG

SEQ ID NO: 830 - protein, 9 aa, Artificial Sequence
  Description of Artificial Sequence: Synthetic peptide
RTFGDYAMG

SEQ ID NO: 831 - protein, 9 aa, Artificial Sequence
  Description of Artificial Sequence: Synthetic peptide
GTFSNSGMG

SEQ ID NO: 832 - protein, 11 aa, Artificial Sequence
  Description of Artificial Sequence: Synthetic peptide
QLANFASYAMG

SEQ ID NO: 833 - protein, 9 aa, Artificial Sequence
  Description of Artificial Sequence: Synthetic peptide
RTFSDDIMG

SEQ ID NO: 834 - protein, 9 aa, Artificial Sequence
  Description of Artificial Sequence: Synthetic peptide
RTFGDYIMG

SEQ ID NO: 835 - protein, 9 aa, Artificial Sequence
  Description of Artificial Sequence: Synthetic peptide
RTFSDDTMG

SEQ ID NO: 836 - protein, 9 aa, Artificial Sequence
  Description of Artificial Sequence: Synthetic peptide
RTFSDDTMG

SEQ ID NO: 837 - protein, 9 aa, Artificial Sequence
  Description of Artificial Sequence: Synthetic peptide
RTFGDYIMG

SEQ ID NO: 838 - protein, 9 aa, Artificial Sequence
  Description of Artificial Sequence: Synthetic peptide
RTFGDYIMG

SEQ ID NO: 839 - protein, 9 aa, Artificial Sequence
  Description of Artificial Sequence: Synthetic peptide
RTFSDDTMG

SEQ ID NO: 840 - protein, 9 aa, Artificial Sequence
  Description of Artificial Sequence: Synthetic peptide
RTFGDYAMG

SEQ ID NO: 841 - protein, 9 aa, Artificial Sequence
  Description of Artificial Sequence: Synthetic peptide
RTFGDDTMG

SEQ ID NO: 842 - protein, 9 aa, Artificial Sequence
  Description of Artificial Sequence: Synthetic peptide
RTFGDYIMG

SEQ ID NO: 843 - protein, 9 aa, Artificial Sequence
  Description of Artificial Sequence: Synthetic peptide
RTFGDYIMG

SEQ ID NO: 844 - protein, 9 aa, Artificial Sequence
  Description of Artificial Sequence: Synthetic peptide
RTFSDDTMG

SEQ ID NO: 845 - protein, 9 aa, Artificial Sequence
  Description of Artificial Sequence: Synthetic peptide
RTFGDYIMG

SEQ ID NO: 846 - protein, 9 aa, Artificial Sequence
  Description of Artificial Sequence: Synthetic peptide
RTFSDDTMG

SEQ ID NO: 847 - protein, 9 aa, Artificial Sequence
  Description of Artificial Sequence: Synthetic peptide
RTFSDYTMG

SEQ ID NO: 848 - protein, 9 aa, Artificial Sequence
  Description of Artificial Sequence: Synthetic peptide
RTFGDDTMG

SEQ ID NO: 849 - protein, 9 aa, Artificial Sequence
  Description of Artificial Sequence: Synthetic peptide
FAFGDNWIG

SEQ ID NO: 850 - protein, 9 aa, Artificial Sequence
  Description of Artificial Sequence: Synthetic peptide
RTFSDDAMG

SEQ ID NO: 851 - protein, 9 aa, Artificial Sequence
  Description of Artificial Sequence: Synthetic peptide
RTFSDDTMG

SEQ ID NO: 852 - protein, 9 aa, Artificial Sequence
  Description of Artificial Sequence: Synthetic peptide
RTFSDDTMG

SEQ ID NO: 853 - protein, 9 aa, Artificial Sequence
  Description of Artificial Sequence: Synthetic peptide
RTFGDDTMG

SEQ ID NO: 854 - protein, 9 aa, Artificial Sequence
  Description of Artificial Sequence: Synthetic peptide
RTFGDYIMG

SEQ ID NO: 855 - protein, 9 aa, Artificial Sequence
  Description of Artificial Sequence: Synthetic peptide
RTFSDDAMG

SEQ ID NO: 856 - protein, 9 aa, Artificial Sequence
  Description of Artificial Sequence: Synthetic peptide
RTFGDYIMG

SEQ ID NO: 857 - protein, 9 aa, Artificial Sequence
  Description of Artificial Sequence: Synthetic peptide
RTFGDDTMG

SEQ ID NO: 858 - protein, 9 aa, Artificial Sequence
  Description of Artificial Sequence: Synthetic peptide
RTFSDDTMG

SEQ ID NO: 859 - protein, 9 aa, Artificial Sequence
  Description of Artificial Sequence: Synthetic peptide
RTFGDYIMG

SEQ ID NO: 860 - protein, 9 aa, Artificial Sequence
  Description of Artificial Sequence: Synthetic peptide
FTFGDYVMG

SEQ ID NO: 861 - protein, 9 aa, Artificial Sequence
  Description of Artificial Sequence: Synthetic peptide
RTFGDYTMG

SEQ ID NO: 862 - protein, 9 aa, Artificial Sequence
  Description of Artificial Sequence: Synthetic peptide
RTFGDYIMG

SEQ ID NO: 863 - protein, 9 aa, Artificial Sequence
  Description of Artificial Sequence: Synthetic peptide
RTFGDYIMG

SEQ ID NO: 864 - protein, 9 aa, Artificial Sequence
  Description of Artificial Sequence: Synthetic peptide
RTFGDYIMG

SEQ ID NO: 865 - protein, 9 aa, Artificial Sequence
  Description of Artificial Sequence: Synthetic peptide
RTFGDYIMG

SEQ ID NO: 866 - protein, 9 aa, Artificial Sequence
  Description of Artificial Sequence: Synthetic peptide
FTWGDYTMG

SEQ ID NO: 867 - protein, 9 aa, Artificial Sequence
  Description of Artificial Sequence: Synthetic peptide
IPSTLRAMG

SEQ ID NO: 868 - protein, 10 aa, Artificial Sequence
  Description of Artificial Sequence: Synthetic peptide
FSFDDDYVMG

SEQ ID NO: 869 - protein, 9 aa, Artificial Sequence
  Description of Artificial Sequence: Synthetic peptide
RTFSNAAMG

SEQ ID NO: 870 - protein, 9 aa, Artificial Sequence
  Description of Artificial Sequence: Synthetic peptide
GTFGVYHMG

SEQ ID NO: 871 - protein, 9 aa, Artificial Sequence
  Description of Artificial Sequence: Synthetic peptide
FTFSSYYMG

SEQ ID NO: 872 - protein, 9 aa, Artificial Sequence
  Description of Artificial Sequence: Synthetic peptide
RTFSGDFMG

SEQ ID NO: 873 - protein, 9 aa, Artificial Sequence
  Description of Artificial Sequence: Synthetic peptide
STLRDYAMG

SEQ ID NO: 874 - protein, 9 aa, Artificial Sequence
  Description of Artificial Sequence: Synthetic peptide
FTFDDYTMG

SEQ ID NO: 875 - protein, 9 aa, Artificial Sequence
  Description of Artificial Sequence: Synthetic peptide
GTFSSYGMG

SEQ ID NO: 876 - protein, 10 aa, Artificial Sequence
  Description of Artificial Sequence: Synthetic peptide
FSFDDDYVMG

SEQ ID NO: 877 - protein, 10 aa, Artificial Sequence
  Description of Artificial Sequence: Synthetic peptide
FSFDDDYVMG

SEQ ID NO: 878 - protein, 9 aa, Artificial Sequence
  Description of Artificial Sequence: Synthetic peptide
NIAAINVMG

SEQ ID NO: 879 - protein, 9 aa, Artificial Sequence
  Description of Artificial Sequence: Synthetic peptide
IITSRYVMG

SEQ ID NO: 880 - protein, 10 aa, Artificial Sequence
  Description of Artificial Sequence: Synthetic peptide
FSFDDDYVMG

SEQ ID NO: 881 - protein, 9 aa, Artificial Sequence
  Description of Artificial Sequence: Synthetic peptide
SISSINVMG

SEQ ID NO: 882 - protein, 9 aa, Artificial Sequence
  Description of Artificial Sequence: Synthetic peptide
LTFILYRMG

SEQ ID NO: 883 - protein, 9 aa, Artificial Sequence
  Description of Artificial Sequence: Synthetic peptide
GTFSVYHMG

SEQ ID NO: 884 - protein, 9 aa, Artificial Sequence
  Description of Artificial Sequence: Synthetic peptide
RAFSTYGMG

SEQ ID NO: 885 - protein, 9 aa, Artificial Sequence
  Description of Artificial Sequence: Synthetic peptide
RTFSDIAMG

SEQ ID NO: 886 - protein, 9 aa, Artificial Sequence
  Description of Artificial Sequence: Synthetic peptide
RTFSSARMG

SEQ ID NO: 887 - protein, 9 aa, Artificial Sequence
  Description of Artificial Sequence: Synthetic peptide
FAFSSYAMG

SEQ ID NO: 888 - protein, 9 aa, Artificial Sequence
  Description of Artificial Sequence: Synthetic peptide
ITFRRHDMG

SEQ ID NO: 889 - protein, 9 aa, Artificial Sequence
  Description of Artificial Sequence: Synthetic peptide
TAASFNPMG

SEQ ID NO: 890 - protein, 9 aa, Artificial Sequence
  Description of Artificial Sequence: Synthetic peptide
NINIINYMG

SEQ ID NO: 891 - protein, 9 aa, Artificial Sequence
  Description of Artificial Sequence: Synthetic peptide
FTFDDYAMG

SEQ ID NO: 892 - protein, 9 aa, Artificial Sequence
  Description of Artificial Sequence: Synthetic peptide
NIFTRNVMG

SEQ ID NO: 893 - protein, 9 aa, Artificial Sequence
  Description of Artificial Sequence: Synthetic peptide
RTFSSIAMG

SEQ ID NO: 894 - protein, 9 aa, Artificial Sequence
  Description of Artificial Sequence: Synthetic peptide
IPSTLRAMG

SEQ ID NO: 895 - protein, 9 aa, Artificial Sequence
  Description of Artificial Sequence: Synthetic peptide
FTLDDSAMG

SEQ ID NO: 896 - protein, 9 aa, Artificial Sequence
  Description of Artificial Sequence: Synthetic peptide
SISSFNAMG

SEQ ID NO: 897 - protein, 9 aa, Artificial Sequence
  Description of Artificial Sequence: Synthetic peptide
NIFSDNIIG

SEQ ID NO: 898 - protein, 9 aa, Artificial Sequence
  Description of Artificial Sequence: Synthetic peptide
SISSIGAMG

SEQ ID NO: 899 - protein, 9 aa, Artificial Sequence
  Description of Artificial Sequence: Synthetic peptide
FTFDDYGMG

SEQ ID NO: 900 - protein, 9 aa, Artificial Sequence
  Description of Artificial Sequence: Synthetic peptide
RTFSNYTMG

SEQ ID NO: 901 - protein, 6 aa, Artificial Sequence
  Description of Artificial Sequence: Synthetic peptide
STNYMG

SEQ ID NO: 902 - protein, 9 aa, Artificial Sequence
  Description of Artificial Sequence: Synthetic peptide
GTFSSVGMG

SEQ ID NO: 903 - protein, 9 aa, Artificial Sequence
  Description of Artificial Sequence: Synthetic peptide
RIFTNTAMG

SEQ ID NO: 904 - protein, 9 aa, Artificial Sequence
  Description of Artificial Sequence: Synthetic peptide
EEFSDHWMG

SEQ ID NO: 905 - protein, 9 aa, Artificial Sequence
  Description of Artificial Sequence: Synthetic peptide
RTFSSIAMG

SEQ ID NO: 906 - protein, 9 aa, Artificial Sequence
  Description of Artificial Sequence: Synthetic peptide
STSSLRTMG

SEQ ID NO: 907 - protein, 10 aa, Artificial Sequence
  Description of Artificial Sequence: Synthetic peptide
GGTFGSYAMG

SEQ ID NO: 908 - protein, 9 aa, Artificial Sequence
  Description of Artificial Sequence: Synthetic peptide
RTFSNAAMG

SEQ ID NO: 909 - protein, 9 aa, Artificial Sequence
  Description of Artificial Sequence: Synthetic peptide
IILSDNAMG

SEQ ID NO: 910 - protein, 9 aa, Artificial Sequence
  Description of Artificial Sequence: Synthetic peptide
RTFGDYIMG

SEQ ID NO: 911 - protein, 9 aa, Artificial Sequence
  Description of Artificial Sequence: Synthetic peptide
FNFNWYPMG

SEQ ID NO: 912 - protein, 9 aa, Artificial Sequence
  Description of Artificial Sequence: Synthetic peptide
SIRSVSVMG

SEQ ID NO: 913 - protein, 9 aa, Artificial Sequence
  Description of Artificial Sequence: Synthetic peptide
MTFRLYAMG

SEQ ID NO: 914 - protein, 9 aa, Artificial Sequence
  Description of Artificial Sequence: Synthetic peptide
RTFSDDAMG

SEQ ID NO: 915 - protein, 9 aa, Artificial Sequence
  Description of Artificial Sequence: Synthetic peptide
GTFSVYAMG

SEQ ID NO: 916 - protein, 9 aa, Artificial Sequence
  Description of Artificial Sequence: Synthetic peptide
FALGYYAMG

SEQ ID NO: 917 - protein, 9 aa, Artificial Sequence
  Description of Artificial Sequence: Synthetic peptide
FNLDDYAMG

SEQ ID NO: 918 - protein, 9 aa, Artificial Sequence
  Description of Artificial Sequence: Synthetic peptide
NTFSGGFMG

SEQ ID NO: 919 - protein, 9 aa, Artificial Sequence
  Description of Artificial Sequence: Synthetic peptide
SIRSINIMG

SEQ ID NO: 920 - protein, 13 aa, Artificial Sequence
  Description of Artificial Sequence: Synthetic peptide
ARISTSGGSTKYA

SEQ ID NO: 921 - protein, 13 aa, Artificial Sequence
  Description of Artificial Sequence: Synthetic peptide
ARITWNGGSTYYA

SEQ ID NO: 922 - protein, 13 aa, Artificial Sequence
  Description of Artificial Sequence: Synthetic peptide
AAVSWSGSGVYYA

SEQ ID NO: 923 - protein, 13 aa, Artificial Sequence
  Description of Artificial Sequence: Synthetic peptide
GAVSWSGGTTVYA

SEQ ID NO: 924 - protein, 13 aa, Artificial Sequence
  Description of Artificial Sequence: Synthetic peptide
AAINWSAGYTAYA

SEQ ID NO: 925 - protein, 15 aa, Artificial Sequence
  Description of Artificial Sequence: Synthetic peptide
AAISWSGGSTYTAYA

SEQ ID NO: 926 - protein, 13 aa, Artificial Sequence
  Description of Artificial Sequence: Synthetic peptide
ARILWTGASRNYA

SEQ ID NO: 927 - protein, 13 aa, Artificial Sequence
  Description of Artificial Sequence: Synthetic peptide
AAISWNGDFTAYA

SEQ ID NO: 928 - protein, 13 aa, Artificial Sequence
  Description of Artificial Sequence: Synthetic peptide
AGINWESGSTNYA

SEQ ID NO: 929 - protein, 12 aa, Artificial Sequence
  Description of Artificial Sequence: Synthetic peptide
AAIGSGGYTDYA

SEQ ID NO: 930 - protein, 12 aa, Artificial Sequence
  Description of Artificial Sequence: Synthetic peptide
SAVDSGGSTYYA

SEQ ID NO: 931 - protein, 13 aa, Artificial Sequence
  Description of Artificial Sequence: Synthetic peptide
AAVTWSGGSTYYA

SEQ ID NO: 932 - protein, 13 aa, Artificial Sequence
  Description of Artificial Sequence: Synthetic peptide
AAINWSAGYTPYA

SEQ ID NO: 933 - protein, 13 aa, Artificial Sequence
  Description of Artificial Sequence: Synthetic peptide
AAIHWSAGYTRYA

SEQ ID NO: 934 - protein, 13 aa, Artificial Sequence
  Description of Artificial Sequence: Synthetic peptide
AAINWSADYTPYA

SEQ ID NO: 935 - protein, 13 aa, Artificial Sequence
  Description of Artificial Sequence: Synthetic peptide
AAINWSAGYTAYA

SEQ ID NO: 936 - protein, 13 aa, Artificial Sequence
  Description of Artificial Sequence: Synthetic peptide
AAINWSGGSTDYA

SEQ ID NO: 937 - protein, 13 aa, Artificial Sequence
  Description of Artificial Sequence: Synthetic peptide
AGINWSGGNTYYA

SEQ ID NO: 938 - protein, 13 aa, Artificial Sequence
  Description of Artificial Sequence: Synthetic peptide
AAINWTGGYTSYA

SEQ ID NO: 939 - protein, 13 aa, Artificial Sequence
  Description of Artificial Sequence: Synthetic peptide
AAINWSGGNTYYA

SEQ ID NO: 940 - protein, 13 aa, Artificial Sequence
  Description of Artificial Sequence: Synthetic peptide
AAINWSGGYTYYA

SEQ ID NO: 941 - protein, 13 aa, Artificial Sequence
  Description of Artificial Sequence: Synthetic peptide
ATINWSGALTHYA

SEQ ID NO: 942 - protein, 13 aa, Artificial Sequence
  Description of Artificial Sequence: Synthetic peptide
AGVTWSGSSTFYA

SEQ ID NO: 943 - protein, 13 aa, Artificial Sequence
  Description of Artificial Sequence: Synthetic peptide
AAISWSGGNTHYA

SEQ ID NO: 944 - protein, 13 aa, Artificial Sequence
  Description of Artificial Sequence: Synthetic peptide
AAINWSAGYTAYA

SEQ ID NO: 945 - protein, 13 aa, Artificial Sequence
  Description of Artificial Sequence: Synthetic peptide
AAVSGSGDDTYYA

SEQ ID NO: 946 - protein, 13 aa, Artificial Sequence
  Description of Artificial Sequence: Synthetic peptide
AAINWSAGYTAYA

SEQ ID NO: 947 - protein, 13 aa, Artificial Sequence
  Description of Artificial Sequence: Synthetic peptide
AAINWSGGYTPYA

SEQ ID NO: 948 - protein, 13 aa, Artificial Sequence
  Description of Artificial Sequence: Synthetic peptide
AAINWSAGYTPYA

SEQ ID NO: 949 - protein, 13 aa, Artificial Sequence
  Description of Artificial Sequence: Synthetic peptide
AAISWSGGTTRYA

SEQ ID NO: 950 - protein, 13 aa, Artificial Sequence
  Description of Artificial Sequence: Synthetic peptide
AAINWSGDSTYYA

SEQ ID NO: 951 - protein, 13 aa, Artificial Sequence
  Description of Artificial Sequence: Synthetic peptide
AAINWSGGTTRYA

SEQ ID NO: 952 - protein, 13 aa, Artificial Sequence
  Description of Artificial Sequence: Synthetic peptide
AAIHWSGSSTRYA

SEQ ID NO: 953 - protein, 13 aa, Artificial Sequence
  Description of Artificial Sequence: Synthetic peptide
GTINWSGGSTYYA

SEQ ID NO: 954 - protein, 13 aa, Artificial Sequence
  Description of Artificial Sequence: Synthetic peptide
AAINWSGGYTPYA

SEQ ID NO: 955 - protein, 13 aa, Artificial Sequence
  Description of Artificial Sequence: Synthetic peptide
AAINWNGGNTHYA

SEQ ID NO: 956 - protein, 13 aa, Artificial Sequence
  Description of Artificial Sequence: Synthetic peptide
AAINWSGGTTRYA

SEQ ID NO: 957 - protein, 13 aa, Artificial Sequence
  Description of Artificial Sequence: Synthetic peptide
AAINWSAGYTPYA

SEQ ID NO: 958 - protein, 13 aa, Artificial Sequence
  Description of Artificial Sequence: Synthetic peptide
ASINWSGGSTYYA

SEQ ID NO: 959 - protein, 13 aa, Artificial Sequence
  Description of Artificial Sequence: Synthetic peptide
AGISWNGGSIYYA

SEQ ID NO: 960 - protein, 13 aa, Artificial Sequence
  Description of Artificial Sequence: Synthetic peptide
AAISWRGGTTYYA

SEQ ID NO: 961 - protein, 13 aa, Artificial Sequence
  Description of Artificial Sequence: Synthetic peptide
AAINWSGGYTPYA

SEQ ID NO: 962 - protein, 13 aa, Artificial Sequence
  Description of Artificial Sequence: Synthetic peptide
AAINWSGGSTRYA

SEQ ID NO: 963 - protein, 13 aa, Artificial Sequence
  Description of Artificial Sequence: Synthetic peptide
AVINWSGGSTDYA

SEQ ID NO: 964 - protein, 13 aa, Artificial Sequence
  Description of Artificial Sequence: Synthetic peptide
AAINWSGGTTPYA

SEQ ID NO: 965 - protein, 13 aa, Artificial Sequence
  Description of Artificial Sequence: Synthetic peptide
AAVSWSGGNTYYA

SEQ ID NO: 966 - protein, 13 aa, Artificial Sequence
  Description of Artificial Sequence: Synthetic peptide
AAINWTGGYTPYA

SEQ ID NO: 967 - protein, 13 aa, Artificial Sequence
  Description of Artificial Sequence: Synthetic peptide
ATINWTAGYTYYA

SEQ ID NO: 968 - protein, 13 aa, Artificial Sequence
  Description of Artificial Sequence: Synthetic peptide
AAINWSGGNTDYA

SEQ ID NO: 969 - protein, 13 aa, Artificial Sequence
  Description of Artificial Sequence: Synthetic peptide
AAINWSGGNTYYA

SEQ ID NO: 970 - protein, 13 aa, Artificial Sequence
  Description of Artificial Sequence: Synthetic peptide
AGINWSGNGVYYA

SEQ ID NO: 971 - protein, 13 aa, Artificial Sequence
  Description of Artificial Sequence: Synthetic peptide
APINWSGGSTYYA

SEQ ID NO: 972 - protein, 13 aa, Artificial Sequence
  Description of Artificial Sequence: Synthetic peptide
AVVNWSGRRTYYA

SEQ ID NO: 973 - protein, 13 aa, Artificial Sequence
  Description of Artificial Sequence: Synthetic peptide
AAITRSGSSTVYA

SEQ ID NO: 974 - protein, 13 aa, Artificial Sequence
  Description of Artificial Sequence: Synthetic peptide
AAINWTGGSTYYA

SEQ ID NO: 975 - protein, 13 aa, Artificial Sequence
  Description of Artificial Sequence: Synthetic peptide
AAINWSAGYTAYA

SEQ ID NO: 976 - protein, 13 aa, Artificial Sequence
  Description of Artificial Sequence: Synthetic peptide
GSINWSGGSTYYA

SEQ ID NO: 977 - protein, 13 aa, Artificial Sequence
  Description of Artificial Sequence: Synthetic peptide
AGMTWSGSSTFYA

SEQ ID NO: 978 - protein, 13 aa, Artificial Sequence
  Description of Artificial Sequence: Synthetic peptide
AAINWSGDYTDYA

SEQ ID NO: 979 - protein, 13 aa, Artificial Sequence
  Description of Artificial Sequence: Synthetic peptide
GGINWSGGYTYYA

SEQ ID NO: 980 - protein, 13 aa, Artificial Sequence
  Description of Artificial Sequence: Synthetic peptide
AAVNWSGGSTYYA

SEQ ID NO: 981 - protein, 13 aa, Artificial Sequence
  Description of Artificial Sequence: Synthetic peptide
AAINWSGGYTRYA

SEQ ID NO: 982 - protein, 13 aa, Artificial Sequence
  Description of Artificial Sequence: Synthetic peptide
AAINWSGGYTPYA

SEQ ID NO: 983 - protein, 13 aa, Artificial Sequence
  Description of Artificial Sequence: Synthetic peptide
AAINWSAGYTAYA

SEQ ID NO: 984 - protein, 13 aa, Artificial Sequence
  Description of Artificial Sequence: Synthetic peptide
AAINWSGGYTHYA

SEQ ID NO: 985 - protein, 13 aa, Artificial Sequence
  Description of Artificial Sequence: Synthetic peptide
AAITWSGGRTRYA

SEQ ID NO: 986 - protein, 13 aa, Artificial Sequence
  Description of Artificial Sequence: Synthetic peptide
AAINWSGGYTAYA

SEQ ID NO: 987 - protein, 13 aa, Artificial Sequence
  Description of Artificial Sequence: Synthetic peptide
AAIHWSGSSTRYA

SEQ ID NO: 988 - protein, 13 aa, Artificial Sequence
  Description of Artificial Sequence: Synthetic peptide
AAINWSGGTTYYA

SEQ ID NO: 989 - protein, 13 aa, Artificial Sequence
  Description of Artificial Sequence: Synthetic peptide
AAINWSGDNTHYA

SEQ ID NO: 990 - protein, 12 aa, Artificial Sequence
  Description of Artificial Sequence: Synthetic peptide
ASISSGGTTAYA

SEQ ID NO: 991 - protein, 13 aa, Artificial Sequence
  Description of Artificial Sequence: Synthetic peptide
GRINWSGGNTYYA

SEQ ID NO: 992 - protein, 13 aa, Artificial Sequence
  Description of Artificial Sequence: Synthetic peptide
GGISWSGGNTYYA

SEQ ID NO: 993 - protein, 13 aa, Artificial Sequence
  Description of Artificial Sequence: Synthetic peptide
AAINWSGGSTYYA

SEQ ID NO: 994 - protein, 13 aa, Artificial Sequence
  Description of Artificial Sequence: Synthetic peptide
AAINWSGGYTYYA

SEQ ID NO: 995 - protein, 13 aa, Artificial Sequence
  Description of Artificial Sequence: Synthetic peptide
AAINWSADYTAYA

SEQ ID NO: 996 - protein, 13 aa, Artificial Sequence
  Description of Artificial Sequence: Synthetic peptide
AAINWSGSSTYYA

SEQ ID NO: 997 - protein, 13 aa, Artificial Sequence
  Description of Artificial Sequence: Synthetic peptide
AAINWIAGYTADA

SEQ ID NO: 998 - protein, 13 aa, Artificial Sequence
  Description of Artificial Sequence: Synthetic peptide
AAINWSGGNTPYA

SEQ ID NO: 999 - protein, 13 aa, Artificial Sequence
  Description of Artificial Sequence: Synthetic peptide
AAINWSGDNTHYA

SEQ ID NO: 1000 - protein, 13 aa, Artificial Sequence
  Description of Artificial Sequence: Synthetic peptide
AAINWSAGYTAYA

SEQ ID NO: 1001 - protein, 13 aa, Artificial Sequence
  Description of Artificial Sequence: Synthetic peptide
AAINWNAGYTAYA

SEQ ID NO: 1002 - protein, 13 aa, Artificial Sequence
  Description of Artificial Sequence: Synthetic peptide
AAINWTGGYTYYA

SEQ ID NO: 1003 - protein, 13 aa, Artificial Sequence
  Description of Artificial Sequence: Synthetic peptide
AAINWSAGYTAYA

SEQ ID NO: 1004 - protein, 13 aa, Artificial Sequence
  Description of Artificial Sequence: Synthetic peptide
AAINWSGDNTHYA

SEQ ID NO: 1005 - protein, 13 aa, Artificial Sequence
  Description of Artificial Sequence: Synthetic peptide
AAINWSAGYTPYA

SEQ ID NO: 1006 - protein, 13 aa, Artificial Sequence
  Description of Artificial Sequence: Synthetic peptide
AAINWSAGYTAYA

SEQ ID NO: 1007 - protein, 13 aa, Artificial Sequence
  Description of Artificial Sequence: Synthetic peptide
AAINWSGGNTYYA

SEQ ID NO: 1008 - protein, 13 aa, Artificial Sequence
  Description of Artificial Sequence: Synthetic peptide
AAVSSLGPFTRYA

SEQ ID NO: 1009 - protein, 13 aa, Artificial Sequence
  Description of Artificial Sequence: Synthetic peptide
AAINWSGGSTYYA

SEQ ID NO: 1010 - protein, 13 aa, Artificial Sequence
  Description of Artificial Sequence: Synthetic peptide
ARILWTGASRSYA

SEQ ID NO: 1011 - protein, 13 aa, Artificial Sequence
  Description of Artificial Sequence: Synthetic peptide
AAINMSGDDSAYA

SEQ ID NO: 1012 - protein, 10 aa, Artificial Sequence
  Description of Artificial Sequence: Synthetic peptide
ARISGSTFYA

SEQ ID NO: 1013 - protein, 13 aa, Artificial Sequence
  Description of Artificial Sequence: Synthetic peptide
GRINWSGGNTYYA

SEQ ID NO: 1014 - protein, 13 aa, Artificial Sequence
  Description of Artificial Sequence: Synthetic peptide
AAITWSGGSTAYA

SEQ ID NO: 1015 - protein, 13 aa, Artificial Sequence
  Description of Artificial Sequence: Synthetic peptide
AAITDNGGSKYYA

SEQ ID NO: 1016 - protein, 13 aa, Artificial Sequence
  Description of Artificial Sequence: Synthetic peptide
AAINWSGASTYYA

SEQ ID NO: 1017 - protein, 13 aa, Artificial Sequence
  Description of Artificial Sequence: Synthetic peptide
AAISWSEDNTYYA

SEQ ID NO: 1018 - protein, 13 aa, Artificial Sequence
  Description of Artificial Sequence: Synthetic peptide
AAVSGSGDDTYYA

SEQ ID NO: 1019 - protein, 13 aa, Artificial Sequence
  Description of Artificial Sequence: Synthetic peptide
AAISASGRRTDYA

SEQ ID NO: 1020 - protein, 12 aa, Artificial Sequence
  Description of Artificial Sequence: Synthetic peptide
AAISTGGSTIYA

SEQ ID NO: 1021 - protein, 13 aa, Artificial Sequence
  Description of Artificial Sequence: Synthetic peptide
AAISNSGLSTYYA

SEQ ID NO: 1022 - protein, 13 aa, Artificial Sequence
  Description of Artificial Sequence: Synthetic peptide
ATMRWSTGSTYYA

SEQ ID NO: 1023 - protein, 12 aa, Artificial Sequence
  Description of Artificial Sequence: Synthetic peptide
AAINNFGTTKYA

SEQ ID NO: 1024 - protein, 13 aa, Artificial Sequence
  Description of Artificial Sequence: Synthetic peptide
AAISWSGGSTAYA

SEQ ID NO: 1025 - protein, 13 aa, Artificial Sequence
  Description of Artificial Sequence: Synthetic peptide
AGINWSGDTPYYA

SEQ ID NO: 1026 - protein, 13 aa, Artificial Sequence
  Description of Artificial Sequence: Synthetic peptide
ASINWGGGNTYYA

SEQ ID NO: 1027 - protein, 13 aa, Artificial Sequence
  Description of Artificial Sequence: Synthetic peptide
AAISWSGDNTHYA

SEQ ID NO: 1028 - protein, 12 aa, Artificial Sequence
  Description of Artificial Sequence: Synthetic peptide
ATINGDDYTYYA

SEQ ID NO: 1029 - protein, 13 aa, Artificial Sequence
  Description of Artificial Sequence: Synthetic peptide
AAIRWSSSSTVYA

SEQ ID NO: 1030 - protein, 12 aa, Artificial Sequence
  Description of Artificial Sequence: Synthetic peptide
AAITSGGSTNYA

SEQ ID NO: 1031 - protein, 13 aa, Artificial Sequence
  Description of Artificial Sequence: Synthetic peptide
AAIHWNGDSTAYA

SEQ ID NO: 1032 - protein, 13 aa, Artificial Sequence
  Description of Artificial Sequence: Synthetic peptide
AAISGSGGSTAYA

SEQ ID NO: 1033 - protein, 12 aa, Artificial Sequence
  Description of Artificial Sequence: Synthetic peptide
AAITSSGSTNYA

SEQ ID NO: 1034 - protein, 13 aa, Artificial Sequence
  Description of Artificial Sequence: Synthetic peptide
ASINWGGGNTIYA

SEQ ID NO: 1035 - protein, 13 aa, Artificial Sequence
  Description of Artificial Sequence: Synthetic peptide
AAVSSLGPFTRYA

SEQ ID NO: 1036 - protein, 12 aa, Artificial Sequence
  Description of Artificial Sequence: Synthetic peptide
AAITNGGSTYYA

SEQ ID NO: 1037 - protein, 12 aa, Artificial Sequence
  Description of Artificial Sequence: Synthetic peptide
AAIDWDGSTAYA

SEQ ID NO: 1038 - protein, 12 aa, Artificial Sequence
  Description of Artificial Sequence: Synthetic peptide
AYYTSGGSIDYA

SEQ ID NO: 1039 - protein, 13 aa, Artificial Sequence
  Description of Artificial Sequence: Synthetic peptide
AAISSSGSSTVYA

SEQ ID NO: 1040 - protein, 13 aa, Artificial Sequence
  Description of Artificial Sequence: Synthetic peptide
ATITWSGDSTYYA

SEQ ID NO: 1041 - protein, 13 aa, Artificial Sequence
  Description of Artificial Sequence: Synthetic peptide
SAISWSTGSTYYA

SEQ ID NO: 1042 - protein, 13 aa, Artificial Sequence
  Description of Artificial Sequence: Synthetic peptide
AAISMSGDDTIYA

SEQ ID NO: 1043 - protein, 13 aa, Artificial Sequence
  Description of Artificial Sequence: Synthetic peptide
AVINWSGARTYYA

SEQ ID NO: 1044 - protein, 13 aa, Artificial Sequence
  Description of Artificial Sequence: Synthetic peptide
AAINWSGGSTAYA

SEQ ID NO: 1045 - protein, 13 aa, Artificial Sequence
  Description of Artificial Sequence: Synthetic peptide
GAIHWSGGRTYYA

SEQ ID NO: 1046 - protein, 13 aa, Artificial Sequence
  Description of Artificial Sequence: Synthetic peptide
AAINWSGARTAYA

SEQ ID NO: 1047 - protein, 13 aa, Artificial Sequence
  Description of Artificial Sequence: Synthetic peptide
AAISSRDGSTIYA

SEQ ID NO: 1048 - protein, 17 aa, Artificial Sequence
  Description of Artificial Sequence: Synthetic peptide
AAISIASGASGGTTNYA

SEQ ID NO: 1049 - protein, 13 aa, Artificial Sequence
  Description of Artificial Sequence: Synthetic peptide
ARITWNGGSTFYA

SEQ ID NO: 1050 - protein, 13 aa, Artificial Sequence
  Description of Artificial Sequence: Synthetic peptide
AAISWLGESTYYA

SEQ ID NO: 1051 - protein, 13 aa, Artificial Sequence
  Description of Artificial Sequence: Synthetic peptide
AAINWNGGYTAYA

SEQ ID NO: 1052 - protein, 15 aa, Artificial Sequence
  Description of Artificial Sequence: Synthetic peptide
AAISWTGVSTYTAYA

SEQ ID NO: 1053 - protein, 13 aa, Artificial Sequence
  Description of Artificial Sequence: Synthetic peptide
AAISWSGVGTAYA

SEQ ID NO: 1054 - protein, 13 aa, Artificial Sequence
  Description of Artificial Sequence: Synthetic peptide
GAINWLSESTYYA

SEQ ID NO: 1055 - protein, 13 aa, Artificial Sequence
  Description of Artificial Sequence: Synthetic peptide
AAINWSGGSTYYA

SEQ ID NO: 1056 - protein, 13 aa, Artificial Sequence
  Description of Artificial Sequence: Synthetic peptide
AAISMSGDDAAYA

SEQ ID NO: 1057 - protein, 13 aa, Artificial Sequence
  Description of Artificial Sequence: Synthetic peptide
AAISSRDGSTAYA

SEQ ID NO: 1058 - protein, 13 aa, Artificial Sequence
  Description of Artificial Sequence: Synthetic peptide
AAISWDGGATAYA

SEQ ID NO: 1059 - protein, 12 aa, Artificial Sequence
  Description of Artificial Sequence: Synthetic peptide
ASIRSGARTYYA

SEQ ID NO: 1060 - protein, 13 aa, Artificial Sequence
  Description of Artificial Sequence: Synthetic peptide
AAISWSGGSTVYA

SEQ ID NO: 1061 - skipped

SEQ ID NO: 1062 - protein, 13 aa, Artificial Sequence
  Description of Artificial Sequence: Synthetic peptide
CARTTVTTPPLIW

SEQ ID NO: 1063 - protein, 11 aa, Artificial Sequence
  Description of Artificial Sequence: Synthetic peptide
CATTENPNPRW

SEQ ID NO: 1064 - protein, 9 aa, Artificial Sequence
  Description of Artificial Sequence: Synthetic peptide
CATDPPLFW

SEQ ID NO: 1065 - protein, 11 aa, Artificial Sequence
  Description of Artificial Sequence: Synthetic peptide
CATTEDPYPRW

SEQ ID NO: 1066 - protein, 15 aa, Artificial Sequence
  Description of Artificial Sequence: Synthetic peptide
CARASPNTGWHFDHW

SEQ ID NO: 1067 - protein, 11 aa, Artificial Sequence
  Description of Artificial Sequence: Synthetic peptide
CAAYQAGWGDW

SEQ ID NO: 1068 - protein, 11 aa, Artificial Sequence
  Description of Artificial Sequence: Synthetic peptide
CATTENPNPRW

SEQ ID NO: 1069 - protein, 15 aa, Artificial Sequence
  Description of Artificial Sequence: Synthetic peptide
CAKRANPTGAYFDYW

SEQ ID NO: 1070 - protein, 20 aa, Artificial Sequence
  Description of Artificial Sequence: Synthetic peptide
CAADRGVYGGRWYRTSQYTW

SEQ ID NO: 1071 - protein, 17 aa, Artificial Sequence
  Description of Artificial Sequence: Synthetic peptide
CAVKPGWVARDPSQYNW

SEQ ID NO: 1072 - protein, 13 aa, Artificial Sequence
  Description of Artificial Sequence: Synthetic peptide
CAASPSLRSAWQW

SEQ ID NO: 1073 - protein, 18 aa, Artificial Sequence
  Description of Artificial Sequence: Synthetic peptide
CAADRRGLASTRAADYDW

SEQ ID NO: 1074 - protein, 15 aa, Artificial Sequence
  Description of Artificial Sequence: Synthetic peptide
CATAPPLFCWHFDLW

SEQ ID NO: 1075 - protein, 15 aa, Artificial Sequence
  Description of Artificial Sequence: Synthetic peptide
CATDPPLFWGHVDLW

SEQ ID NO: 1076 - protein, 15 aa, Artificial Sequence
  Description of Artificial Sequence: Synthetic peptide
CATAPPNTGWHFDHW

SEQ ID NO: 1077 - protein, 15 aa, Artificial Sequence
  Description of Artificial Sequence: Synthetic peptide
CATATPNTGWHFDHW

SEQ ID NO: 1078 - protein, 9 aa, Artificial Sequence
  Description of Artificial Sequence: Synthetic peptide
CATDPPLFW

SEQ ID NO: 1079 - protein, 9 aa, Artificial Sequence
  Description of Artificial Sequence: Synthetic peptide
CATDPPLFW

SEQ ID NO: 1080 - protein, 9 aa, Artificial Sequence
  Description of Artificial Sequence: Synthetic peptide
CATDPPLFW

SEQ ID NO: 1081 - protein, 9 aa, Artificial Sequence
  Description of Artificial Sequence: Synthetic peptide
CATDPPLFW

SEQ ID NO: 1082 - protein, 9 aa, Artificial Sequence
  Description of Artificial Sequence: Synthetic peptide
CATDPPLFW

SEQ ID NO: 1083 - protein, 23 aa, Artificial Sequence
  Description of Artificial Sequence: Synthetic peptide
CATLPFYDFWSGYYTGYYYMDVW

SEQ ID NO: 1084 - protein, 9 aa, Artificial Sequence
  Description of Artificial Sequence: Synthetic peptide
CATDPPLFW

SEQ ID NO: 1085 - protein, 9 aa, Artificial Sequence
  Description of Artificial Sequence: Synthetic peptide
CATDPPLFW

SEQ ID NO: 1086 - protein, 15 aa, Artificial Sequence
  Description of Artificial Sequence: Synthetic peptide
CATASPNTGWHFDHW

SEQ ID NO: 1087 - protein, 18 aa, Artificial Sequence
  Description of Artificial Sequence: Synthetic peptide
CAADRRGLASTRAADYDW

SEQ ID NO: 1088 - protein, 15 aa, Artificial Sequence
  Description of Artificial Sequence: Synthetic peptide
CATEPPLSCWHFDLW

SEQ ID NO: 1089 - protein, 15 aa, Artificial Sequence
  Description of Artificial Sequence: Synthetic peptide
CATAPPNTGWHFDHW

SEQ ID NO: 1090 - protein, 15 aa, Artificial Sequence
  Description of Artificial Sequence: Synthetic peptide
CATDPPLFCCHFDLW

SEQ ID NO: 1091 - protein, 9 aa, Artificial Sequence
  Description of Artificial Sequence: Synthetic peptide
CATDPPLFW

SEQ ID NO: 1092 - protein, 9 aa, Artificial Sequence
  Description of Artificial Sequence: Synthetic peptide
CATDPPLFW

SEQ ID NO: 1093 - protein, 9 aa, Artificial Sequence
  Description of Artificial Sequence: Synthetic peptide
CATDPPLFW

SEQ ID NO: 1094 - protein, 9 aa, Artificial Sequence
  Description of Artificial Sequence: Synthetic peptide
CATDPPLFW

SEQ ID NO: 1095 - protein, 9 aa, Artificial Sequence
  Description of Artificial Sequence: Synthetic peptide
CATDPPLFW

SEQ ID NO: 1096 - protein, 9 aa, Artificial Sequence
  Description of Artificial Sequence: Synthetic peptide
CATDPPLFW

SEQ ID NO: 1097 - protein, 9 aa, Artificial Sequence
  Description of Artificial Sequence: Synthetic peptide
CATDPPLFW

SEQ ID NO: 1098 - protein, 9 aa, Artificial Sequence
  Description of Artificial Sequence: Synthetic peptide
CATDPPLFW

SEQ ID NO: 1099 - protein, 15 aa, Artificial Sequence
  Description of Artificial Sequence: Synthetic peptide
CATDPPLFWGHVDLW

SEQ ID NO: 1100 - protein, 9 aa, Artificial Sequence
  Description of Artificial Sequence: Synthetic peptide
CATDPPLFW

SEQ ID NO: 1101 - protein, 9 aa, Artificial Sequence
  Description of Artificial Sequence: Synthetic peptide
CATDPPLFW

SEQ ID NO: 1102 - protein, 18 aa, Artificial Sequence
  Description of Artificial Sequence: Synthetic peptide
CAADRRGLASTRAGDYDW

SEQ ID NO: 1103 - protein, 15 aa, Artificial Sequence
  Description of Artificial Sequence: Synthetic peptide
CATDPPLFWGHVDLW

SEQ ID NO: 1104 - protein, 9 aa, Artificial Sequence
  Description of Artificial Sequence: Synthetic peptide
CATDPPLFW

SEQ ID NO: 1105 - protein, 23 aa, Artificial Sequence
  Description of Artificial Sequence: Synthetic peptide
CARGGGWVPSSTSESLNWYFDRW

SEQ ID NO: 1106 - protein, 15 aa, Artificial Sequence
  Description of Artificial Sequence: Synthetic peptide
CATDPPLFCCHVDLW

SEQ ID NO: 1107 - protein, 9 aa, Artificial Sequence
  Description of Artificial Sequence: Synthetic peptide
CATDPPLFW

SEQ ID NO: 1108 - protein, 9 aa, Artificial Sequence
  Description of Artificial Sequence: Synthetic peptide
CATDPPLFW

SEQ ID NO: 1109 - protein, 15 aa, Artificial Sequence
  Description of Artificial Sequence: Synthetic peptide
CATDPPLFCWHFDHW

SEQ ID NO: 1110 - protein, 9 aa, Artificial Sequence
  Description of Artificial Sequence: Synthetic peptide
CATDPPLFW

SEQ ID NO: 1111 - protein, 9 aa, Artificial Sequence
  Description of Artificial Sequence: Synthetic peptide
CATDPPLFW

SEQ ID NO: 1112 - protein, 9 aa, Artificial Sequence
  Description of Artificial Sequence: Synthetic peptide
CATDPPLFW

SEQ ID NO: 1113 - protein, 9 aa, Artificial Sequence
  Description of Artificial Sequence: Synthetic peptide
CATDPPLFW

SEQ ID NO: 1114 - protein, 13 aa, Artificial Sequence
  Description of Artificial Sequence: Synthetic peptide
CAVPWMDYNRRDW

SEQ ID NO: 1115 - protein, 11 aa, Artificial Sequence
  Description of Artificial Sequence: Synthetic peptide
CATTMNPNPRW

SEQ ID NO: 1116 - protein, 9 aa, Artificial Sequence
  Description of Artificial Sequence: Synthetic peptide
CATDPPLFW

SEQ ID NO: 1117 - protein, 15 aa, Artificial Sequence
  Description of Artificial Sequence: Synthetic peptide
CATARPNTGWHFDHW

SEQ ID NO: 1118 - protein, 9 aa, Artificial Sequence
  Description of Artificial Sequence: Synthetic peptide
CATDPPLFW

SEQ ID NO: 1119 - protein, 9 aa, Artificial Sequence
  Description of Artificial Sequence: Synthetic peptide
CATDPPLFW

SEQ ID NO: 1120 - protein, 9 aa, Artificial Sequence
  Description of Artificial Sequence: Synthetic peptide
CATDPPLFW

SEQ ID NO: 1121 - protein, 9 aa, Artificial Sequence
  Description of Artificial Sequence: Synthetic peptide
CATDPPLFW

SEQ ID NO: 1122 - protein, 9 aa, Artificial Sequence
  Description of Artificial Sequence: Synthetic peptide
CATDPPLFW

SEQ ID NO: 1123 - protein, 9 aa, Artificial Sequence
  Description of Artificial Sequence: Synthetic peptide
CATDPPLFW

SEQ ID NO: 1124 - protein, 9 aa, Artificial Sequence
  Description of Artificial Sequence: Synthetic peptide
CATDPPLFW

SEQ ID NO: 1125 - protein, 15 aa, Artificial Sequence
  Description of Artificial Sequence: Synthetic peptide
CARASPNTGWHFDRW

SEQ ID NO: 1126 - protein, 9 aa, Artificial Sequence
  Description of Artificial Sequence: Synthetic peptide
CATDPPLFW

SEQ ID NO: 1127 - protein, 9 aa, Artificial Sequence
  Description of Artificial Sequence: Synthetic peptide
CATDRPLFW

SEQ ID NO: 1128 - protein, 15 aa, Artificial Sequence
  Description of Artificial Sequence: Synthetic peptide
CATASPNTGWHFDHW

SEQ ID NO: 1129 - protein, 9 aa, Artificial Sequence
  Description of Artificial Sequence: Synthetic peptide
CATDPPLFW

SEQ ID NO: 1130 - protein, 9 aa, Artificial Sequence
  Description of Artificial Sequence: Synthetic peptide
CATDPPLFW

SEQ ID NO: 1131 - protein, 9 aa, Artificial Sequence
  Description of Artificial Sequence: Synthetic peptide
CATDPPLFW

SEQ ID NO: 1132 - protein, 14 aa, Artificial Sequence
  Description of Artificial Sequence: Synthetic peptide
CAHRGGWLRPWGYW

SEQ ID NO: 1133 - protein, 9 aa, Artificial Sequence
  Description of Artificial Sequence: Synthetic peptide
CATDPPLFW

SEQ ID NO: 1134 - protein, 9 aa, Artificial Sequence
  Description of Artificial Sequence: Synthetic peptide
CATDPPLFW

SEQ ID NO: 1135 - protein, 9 aa, Artificial Sequence
  Description of Artificial Sequence: Synthetic peptide
CATDPPLFW

SEQ ID NO: 1136 - protein, 9 aa, Artificial Sequence
  Description of Artificial Sequence: Synthetic peptide
CATDPPLFW

SEQ ID NO: 1137 - protein, 15 aa, Artificial Sequence
  Description of Artificial Sequence: Synthetic peptide
CATDPPLFCWHFDHW

SEQ ID NO: 1138 - protein, 9 aa, Artificial Sequence
  Description of Artificial Sequence: Synthetic peptide
CATDPPLFW

SEQ ID NO: 1139 - protein, 15 aa, Artificial Sequence
  Description of Artificial Sequence: Synthetic peptide
CAEPSPNTGWHFDHW

SEQ ID NO: 1140 - protein, 9 aa, Artificial Sequence
  Description of Artificial Sequence: Synthetic peptide
CATDPPLFW

SEQ ID NO: 1141 - protein, 9 aa, Artificial Sequence
  Description of Artificial Sequence: Synthetic peptide
CATDPPLFW

SEQ ID NO: 1142 - protein, 15 aa, Artificial Sequence
  Description of Artificial Sequence: Synthetic peptide
CATAPPLFCWHFDHW

SEQ ID NO: 1143 - protein, 15 aa, Artificial Sequence
  Description of Artificial Sequence: Synthetic peptide
CAKASPNTGWHFDHW

SEQ ID NO: 1144 - protein, 9 aa, Artificial Sequence
  Description of Artificial Sequence: Synthetic peptide
CATDPPLFW

SEQ ID NO: 1145 - protein, 15 aa, Artificial Sequence
  Description of Artificial Sequence: Synthetic peptide
CARATPNTGWHFDHW

SEQ ID NO: 1146 - protein, 9 aa, Artificial Sequence
  Description of Artificial Sequence: Synthetic peptide
CATDPPLFW

SEQ ID NO: 1147 - protein, 15 aa, Artificial Sequence
  Description of Artificial Sequence: Synthetic peptide
CATDPPLFCCHFDHW

SEQ ID NO: 1148 - protein, 15 aa, Artificial Sequence
  Description of Artificial Sequence: Synthetic peptide
CATAPPNTGWHFDHW

SEQ ID NO: 1149 - protein, 18 aa, Artificial Sequence
  Description of Artificial Sequence: Synthetic peptide
CAADRRGLASTRAADYDW

SEQ ID NO: 1150 - protein, 17 aa, Artificial Sequence
  Description of Artificial Sequence: Synthetic peptide
CAAKPGWVARDPSQYNW

SEQ ID NO: 1151 - protein, 18 aa, Artificial Sequence
  Description of Artificial Sequence: Synthetic peptide
CAADRRGLASTRAADYDW

SEQ ID NO: 1152 - protein, 11 aa, Artificial Sequence
  Description of Artificial Sequence: Synthetic peptide
CATTENPNPRW

SEQ ID NO: 1153 - protein, 15 aa, Artificial Sequence
  Description of Artificial Sequence: Synthetic peptide
CAILVGPGQVEFDHW

SEQ ID NO: 1154 - protein, 22 aa, Artificial Sequence
  Description of Artificial Sequence: Synthetic peptide
CAALPFVCPSGSYSDYGDEYDW

SEQ ID NO: 1155 - protein, 9 aa, Artificial Sequence
  Description of Artificial Sequence: Synthetic peptide
CPTDPPLFW

SEQ ID NO: 1156 - protein, 14 aa, Artificial Sequence
  Description of Artificial Sequence: Synthetic peptide
CASLLAGDRYFDYW

SEQ ID NO: 1157 - protein, 18 aa, Artificial Sequence
  Description of Artificial Sequence: Synthetic peptide
CAADRRGLASTRAADYDW

SEQ ID NO: 1158 - protein, 17 aa, Artificial Sequence
  Description of Artificial Sequence: Synthetic peptide
CARDWRDRTWGNSLDYW

SEQ ID NO: 1159 - protein, 18 aa, Artificial Sequence
  Description of Artificial Sequence: Synthetic peptide
CAADRRGLASTRAADYDW

SEQ ID NO: 1160 - protein, 18 aa, Artificial Sequence
  Description of Artificial Sequence: Synthetic peptide
CAADRRGLASTRAADYDW

SEQ ID NO: 1161 - protein, 21 aa, Artificial Sequence
  Description of Artificial Sequence: Synthetic peptide
CARRVYYYDSSGPPGVTFDIW

SEQ ID NO: 1162 - protein, 14 aa, Artificial Sequence
  Description of Artificial Sequence: Synthetic peptide
CARQDSSSPYFDYW

SEQ ID NO: 1163 - protein, 18 aa, Artificial Sequence
  Description of Artificial Sequence: Synthetic peptide
CAADRRGLASTRAADYDW

SEQ ID NO: 1164 - protein, 21 aa, Artificial Sequence
  Description of Artificial Sequence: Synthetic peptide
CAQRVRGFFGPLRTTPSWYEW

SEQ ID NO: 1165 - protein, 23 aa, Artificial Sequence
  Description of Artificial Sequence: Synthetic peptide
CARTHYDFWSGYTSRTPNYFDYW

SEQ ID NO: 1166 - protein, 15 aa, Artificial Sequence
  Description of Artificial Sequence: Synthetic peptide
CAAVNTWTSPSFDSW

SEQ ID NO: 1167 - protein, 15 aa, Artificial Sequence
  Description of Artificial Sequence: Synthetic peptide
CAREVGPPPGYFDLW

SEQ ID NO: 1168 - protein, 18 aa, Artificial Sequence
  Description of Artificial Sequence: Synthetic peptide
CAAKGIWDYLGRRDFGDW

SEQ ID NO: 1169 - protein, 11 aa, Artificial Sequence
  Description of Artificial Sequence: Synthetic peptide
CATTENPNPRW

SEQ ID NO: 1170 - protein, 11 aa, Artificial Sequence
  Description of Artificial Sequence: Synthetic peptide
CVATPGGYGLW

SEQ ID NO: 1171 - protein, 20 aa, Artificial Sequence
  Description of Artificial Sequence: Synthetic peptide
CAADRGVYGGRWYRTSQYTW

SEQ ID NO: 1172 - protein, 15 aa, Artificial Sequence
  Description of Artificial Sequence: Synthetic peptide
CAAIAYEEGVYRWDW

SEQ ID NO: 1173 - protein, 14 aa, Artificial Sequence
  Description of Artificial Sequence: Synthetic peptide
CASGPPYSNYFAYW

SEQ ID NO: 1174 - protein, 15 aa, Artificial Sequence
  Description of Artificial Sequence: Synthetic peptide
CAKIMGSGRPYFDHW

SEQ ID NO: 1175 - protein, 15 aa, Artificial Sequence
  Description of Artificial Sequence: Synthetic peptide
CARPSSDLQGGVDYW

SEQ ID NO: 1176 - protein, 18 aa, Artificial Sequence
  Description of Artificial Sequence: Synthetic peptide
CAAKGIWDYLGRRDFGDW

SEQ ID NO: 1177 - protein, 17 aa, Artificial Sequence
  Description of Artificial Sequence: Synthetic peptide
CAAKPGWVARDPSEYNW

SEQ ID NO: 1178 - protein, 14 aa, Artificial Sequence
  Description of Artificial Sequence: Synthetic peptide
CARFARGSPYFDFW

SEQ ID NO: 1179 - protein, 16 aa, Artificial Sequence
  Description of Artificial Sequence: Synthetic peptide
CARGGGYYGSGSFEYW

SEQ ID NO: 1180 - protein, 18 aa, Artificial Sequence
  Description of Artificial Sequence: Synthetic peptide
CARGTAVGRPPPGGMDVW

SEQ ID NO: 1181 - protein, 14 aa, Artificial Sequence
  Description of Artificial Sequence: Synthetic peptide
CARVPPGQAYFDSW

SEQ ID NO: 1182 - protein, 18 aa, Artificial Sequence
  Description of Artificial Sequence: Synthetic peptide
CAKGGSWYYDSSGYYGRW

SEQ ID NO: 1183 - protein, 13 aa, Artificial Sequence
  Description of Artificial Sequence: Synthetic peptide
CAADRYGPPWYDW

SEQ ID NO: 1184 - protein, 14 aa, Artificial Sequence
  Description of Artificial Sequence: Synthetic peptide
CARIGLRGRYFDLW

SEQ ID NO: 1185 - protein, 13 aa, Artificial Sequence
  Description of Artificial Sequence: Synthetic peptide
CAVPWMDYNRRDW

SEQ ID NO: 1186 - protein, 13 aa, Artificial Sequence
  Description of Artificial Sequence: Synthetic peptide
CARTSGSYSFDYW

SEQ ID NO: 1187 - protein, 18 aa, Artificial Sequence
  Description of Artificial Sequence: Synthetic peptide
CAADRRGLASTRAADYDW

SEQ ID NO: 1188 - protein, 18 aa, Artificial Sequence
  Description of Artificial Sequence: Synthetic peptide
CAAKGIWDYLGRRDFGDW

SEQ ID NO: 1189 - protein, 14 aa, Artificial Sequence
  Description of Artificial Sequence: Synthetic peptide
CARDDSSSPYFDYW

SEQ ID NO: 1190 - protein, 11 aa, Artificial Sequence
  Description of Artificial Sequence: Synthetic peptide
CATTMNPNPRW

SEQ ID NO: 1191 - protein, 11 aa, Artificial Sequence
  Description of Artificial Sequence: Synthetic peptide
CATTENPNPRW

SEQ ID NO: 1192 - protein, 18 aa, Artificial Sequence
  Description of Artificial Sequence: Synthetic peptide
CAADRRGLASTRAADYDW

SEQ ID NO: 1193 - protein, 15 aa, Artificial Sequence
  Description of Artificial Sequence: Synthetic peptide
CATTSPNTGWHYYRW

SEQ ID NO: 1194 - protein, 21 aa, Artificial Sequence
  Description of Artificial Sequence: Synthetic peptide
CARWGPGPAGGSPGLVGFDYW

SEQ ID NO: 1195 - protein, 11 aa, Artificial Sequence
  Description of Artificial Sequence: Synthetic peptide
CAAYQRGWGDW

SEQ ID NO: 1196 - protein, 17 aa, Artificial Sequence
  Description of Artificial Sequence: Synthetic peptide
CAAKPGWVARDPSEYNW

SEQ ID NO: 1197 - protein, 9 aa, Artificial Sequence
  Description of Artificial Sequence: Synthetic peptide
CATDPPLFW

SEQ ID NO: 1198 - protein, 20 aa, Artificial Sequence
  Description of Artificial Sequence: Synthetic peptide
CAKISKDDGGKPRGAFFDSW

SEQ ID NO: 1199 - protein, 15 aa, Artificial Sequence
  Description of Artificial Sequence: Synthetic peptide
CARLATGPQAYFHHW

SEQ ID NO: 1200 - protein, 14 aa, Artificial Sequence
  Description of Artificial Sequence: Synthetic peptide
CARVGRGTTAFDSW

SEQ ID NO: 1201 - protein, 21 aa, Artificial Sequence
  Description of Artificial Sequence: Synthetic peptide
CAQRVRGFFGPLRTTPSWYEW

SEQ ID NO: 1202 - protein, 14 aa, Artificial Sequence
  Description of Artificial Sequence: Synthetic peptide
CASLLAGDRYFDYW

SEQ ID NO: 1203 - protein, 116 aa, Artificial Sequence
  Description of Artificial Sequence: Synthetic polypeptide
EVQLVESGGGLVQPGGSLRLSCAASGPGTAIMGWFRQAPGKEREFVARISTSGGSTKYADSVKGRFTISADNSKNTAYLQMNSLKPEDTAVYYCARTTVTTPPLIWGQGTLVTVSS

SEQ ID NO: 1204 - protein, 116 aa, Artificial Sequence
  Description of Artificial Sequence: Synthetic polypeptide
EVQLVESGGGLVQPGGSLRLSCAASGRSFSNSVMGWFRQAPGKEREFVARITWNGGSTYYADSVKGRFTISADNSKNTAYLQMNSLKPEDTAVYYCATTENPNPRWGQGTLVTVSS

SEQ ID NO: 1205 - protein, 114 aa, Artificial Sequence
  Description of Artificial Sequence: Synthetic polypeptide
EVQLVESGGGLVQPGGSLRLSCAASGRTFGDDTMGWFRQAPGKEREFVAAVSWSGSGVYYADSVKGRFTITADNSKNTAYLQMNSLKPENTAVYYCATDPPLFWGQGTLVTVSS

SEQ ID NO: 1206 - protein, 116 aa, Artificial Sequence
  Description of Artificial Sequence: Synthetic polypeptide
EVQLVESGGGLVQPGGSLRLSCAASGRTFSDARMGWFRQAPGKEREFVGAVSWSGGTTVYADSVKGRFTISADNSKNTAYLQMNSLKPEDTAVYYCATTEDPYPRWGQGTLVTVSS

SEQ ID NO: 1207 - protein, 120 aa, Artificial Sequence
  Description of Artificial Sequence: Synthetic polypeptide
EVQLVESGGGLVQPGGSLRLSCAASGRTFGDYIMGWFRQAPGKERESVAAINWSAGYTAYADSVKGRFTISADNSKNTAYLQMNSLKPEDTAVYYCARASPNTGWHFDHWGQGTLVTVSS

SEQ ID NO: 1208 - protein, 118 aa, Artificial Sequence
  Description of Artificial Sequence: Synthetic polypeptide
EVQLVESGGGLVQPGGSLRLSCAASGSGLSINAMGWFRQAPGKERESVAAISWSGGSTYTAYADSVKGRFTISADNSKNTAYLQMNSLKPEDTAVYYCAAYQAGWGDWGQGTLVTVSS

SEQ ID NO: 1209 - protein, 116 aa, Artificial Sequence
  Description of Artificial Sequence: Synthetic polypeptide
EVQLVESGGGLVQPGGSLRLSCAASGRTFSNAAMGWFRQAPGKEREFVARILWTGASRNYADSVKGRFTISADNSKNTAYLQMNSLKPEDTAVYYCATTENPNPRWGQGTLVTVSS

SEQ ID NO: 1210 - protein, 120 aa, Artificial Sequence
  Description of Artificial Sequence: Synthetic polypeptide
EVQLVESGGGLVQPGGSLRLSCAASGFSLDYYGMGWFRQAPGKERESVAAISWNGDFTAYADSVKGRFTISADNSKNTAYLQMNSLKPEDTAVYYCAKRANPTGAYFDYWGQGTLVTVSS

SEQ ID NO: 1211 - protein, 125 aa, Artificial Sequence
  Description of Artificial Sequence: Synthetic polypeptide
EVQLVESGGGLVQPGGSLRLSCAASGFTFSRHDMGWFRQAPGKEREFVAGINWESGSTNYADSVKGRFTISADNSKNTAYLQMNSLKPEDTAVYYCAADRGVYGGRWYRTSQYTWGQGTLVTVSS

SEQ ID NO: 1212 - protein, 121 aa, Artificial Sequence
  Description of Artificial Sequence: Synthetic polypeptide
EVQLVESGGGLVQPGGSLRLSCAASGLTFRNYAMGWFRQAPGKEREFVAAIGSGGYTDYADSVKGRFTISADNSKNTAYLQMNSLKPEDTAVYYCAVKPGWVARDPSQYNWGQGTLVTVSS

SEQ ID NO: 1213 - protein, 117 aa, Artificial Sequence
  Description of Artificial Sequence: Synthetic polypeptide
EVQLVESGGGLVQPGGSLRLSCAASGGTFSRYAMGWFRQAPGKEREWVSAVDSGGSTYYADSVKGRFTISADNSKNTAYLQMNSLKPEDTAVYYCAASPSLRSAWQWGQGTLVTVSS

SEQ ID NO: 1214 - protein, 123 aa, Artificial Sequence
  Description of Artificial Sequence: Synthetic polypeptide
EVQLVESGGGLVQPGGSLRLSCAASGFTLDYYDMGWFRQAPGKEREFVAAVTWSGGSTYYADSVKGRFTISADNSKNTAYLQMNSLKPEDTAVYYCAADRRGLASTRAADYDWGQGTLVTVSS

SEQ ID NO: 1215 - protein, 120 aa, Artificial Sequence
  Description of Artificial Sequence: Synthetic polypeptide
EVQLVESGGGLVQPGGSLRLSCAASGRTFGDYIMGWFRQAPGKEREFVAAINWSAGYTPYADSVKGRFTISADNSKNTAYLQMNSLKPEDTAVYYCATAPPLFCWHFDLWGQGTLVTVSS

SEQ ID NO: 1216 - protein, 120 aa, Artificial Sequence
  Description of Artificial Sequence: Synthetic polypeptide
EVQLVESGGGLVQPGGSLRLSCAASGRTFGDDIMGWFRQAPGKEREFVAAIHWSAGYTRYADSVKGRFTISADNSKNTAYLQMNSLKPEDTAVYYCATDPPLFWGHVDLWGQGTLVTVSS

SEQ ID NO: 1217 - protein, 120 aa, Artificial Sequence
  Description of Artificial Sequence: Synthetic polypeptide
EVQLVESGGGLVQPGGSLRLSCAASGRTFGDYIMGWFRQAPGKEREIVAAINWSADYTPYADSVKGRFTISADNSKNTAYLQMNSLKPEDTAVYYCATAPPNTGWHFDHWGQGTLVTVSS

SEQ ID NO: 1218 - protein, 120 aa, Artificial Sequence
  Description of Artificial Sequence: Synthetic polypeptide
EVQLVESGGGLVQPGGSLRLSCAASGRTFGDYIMGWFRQAPGKEREIVAAINWSAGYTAYADSVKGRFTISADNSKNTAYLQMNSLKPEDTAVYYCATATPNTGWHFDHWGQGTLVTVSS

SEQ ID NO: 1219 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAAINWSGGSTDYADSVKGRFTISADNSKNTAYLQMNSLKPEDTAVYYCATDPPLFWGQGTLVTVSS

SEQ ID NO: 1220 - protein, 114 aa, Artificial Sequence
  Description of Artificial Sequence: Synthetic polypeptide
EVQLVESGGGLVQPGGSLRLSCAASGRTFGDDTMGWFRQAPGKEREFVAGINWSGGNTYYADSVKGRFTISADNSKNTAYLQMNSLKPEDTAVYYCATDPPLFWGQGTLVTVSS

SEQ ID NO: 1221 - protein, 114 aa, Artificial Sequence
  Description of Artificial Sequence: Synthetic polypeptide
EVQLVESGGGLVQPGGSLRLSCAASGRTFGDYIMGWFRQAPGKEREFVAAINWTGGYTSYADSVKGRFTISADNSKNTAYLQMNSLKPEDTAVYYCATDPPLFWGQGTLVTVSS

SEQ ID NO: 1222 - protein, 114 aa, Artificial Sequence
  Description of Artificial Sequence: Synthetic polypeptide
EVQLVESGGGLVQPGGSLRLSCAASGRTFGDDTMGWFRQAPGKERECVAAINWSGGNTYYADSVKGRFTISADNSKNTAYLQMNSLKPEDTAVYYCATDPPLFWGQGTLVTVSS

SEQ ID NO: 1223 - protein, 114 aa, Artificial Sequence
  Description of Artificial Sequence: Synthetic polypeptide
EVQLVESGGGLVQPGGSLRLSCAASGRTFSDYTMGWFRQAPGKEREFVAAINWSGGYTYYADSVKGRFTISADNSKNTAYLQMNSLKPEDTAVYYCATDPPLFWGQGTLVTVSS

SEQ ID NO: 1224 - protein, 128 aa, Artificial Sequence
  Description of Artificial Sequence: Synthetic polypeptide
EVQLVESGGGLVQPGGSLRLSCAASGRTFGDYGMGWFRQAPGKEREFVATINWSGALTHYADSVKGRFTISADNSKNTAYLQMNSLKPEDTAVYYCATLPFYDFWSGYYTGYYYMDVWGQGTLVTVSS

SEQ ID NO: 1225 - protein, 114 aa, Artificial Sequence
  Description of Artificial Sequence: Synthetic polypeptide
EVQLVESGGGLVQPGGSLRLSCAASGRTFSDDTMGWFRQAPGKEREFLAGVTWSGSSTFYADSVKGRFTISADNSKNTAYLQMNSLKPEDTAVYYCATDPPLFWGQGTLVTVSS

SEQ ID NO: 1226 - protein, 114 aa, Artificial Sequence
  Description of Artificial Sequence: Synthetic polypeptide
EVQLVESGGGLVQPGGSLRLSCAASGRTFSDDIMGWFRQAPGKEREFVAAISWSGGNTHYADSVKGRFTISADNSKNTAYLQMNSLKPEDTAVYYCATDPPLFWGQGTLVTVSS

SEQ ID NO: 1227 - protein, 120 aa, Artificial Sequence
  Description of Artificial Sequence: Synthetic polypeptide
EVQLVESGGGLVQPGGSLRLSCAASGRTFGDYIMGWFRQAPGKERESVAAINWSAGYTAYADSVKGRFTISADNSKNTAYLQMNSLKPEDTAVYYCATASPNTGWHFDHWGQGTLVTVSS

SEQ ID NO: 1228 - protein, 124 aa, Artificial Sequence
  Description of Artificial Sequence: Synthetic polypeptide
EVQLVESGGGLVQPGGSLRLSCAASGFTFDDDYVMGWFRQAPGKEREFVAAVSGSGDDTYYADSVKGRFTISADNSKNTAYLQMNSLKPEDTAVYYCAADRRGLASTRAADYDWGQGTLVTVSS

SEQ ID NO: 1229 - protein, 120 aa, Artificial Sequence
  Description of Artificial Sequence: Synthetic polypeptide
EVQLVESGGGLVQPGGSLRLSCAASGRTFGDYIMGWFRQAPGKEREFVAAINWSAGYTAYADSVKGRFTISADNSKNTAYLQMNSLKPEDTAVYYCATEPPLSCWHFDLWGQGTLVTVSS

SEQ ID NO: 1230 - protein, 120 aa, Artificial Sequence
  Description of Artificial Sequence: Synthetic polypeptide
EVQLVESGGGLVQPGGSLRLSCAASGRTFGDYIMGWFRQAPGKEREIVAAINWSGGYTPYADSVKGRFTISADNSKNTAYLQMNSLKPEDTAVYYCATAPPNTGWHFDHWGQGTLVTVSS

SEQ ID NO: 1231 - protein, 120 aa, Artificial Sequence
  Description of Artificial Sequence: Synthetic polypeptide
EVQLVESGGGLVQPGGSLRLSCAASGRTFGDDTMGWFRQAPGKEREIVAAINWSAGYTPYADSVKGRFTISADNSKNTAYLQMNSLKPEDTAVYYCATDPPLFCCHFDLWGQGTLVTVSS

SEQ ID NO: 1232 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAAISWSGGTTRYADSVKGRFTISADNSKNTAYLQMNSLKPEDTAVYYCATDPPLFWGQGTLVTVSS

SEQ ID NO: 1233 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAAINWSGDSTYYADSVKGRFTISADNSKNTAYLQMNSLKPEDTAVYYCATDPPLFWGQGTLVTVSS

SEQ ID NO: 1234 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAAINWSGGTTRYADSVKGRFTISADNSKNTAYLQMNSLKPEDTAVYYCATDPPLFWGQGTLVTVSS

SEQ ID NO: 1235 - protein, 114 aa, Artificial Sequence
  Description of Artificial Sequence: Synthetic polypeptide
EVQLVESGGGLVQPGGSLRLSCAASGRTFSDDAMGWFRQAPGKEREFVAAIHWSGSSTRYADSVKGRFTISADNSKNTAYLQMNSLKPEDTAVYYCATDPPLFWGQGTLVTVSS

SEQ ID NO: 1236 - protein, 114 aa, Artificial Sequence
  Description of Artificial Sequence: Synthetic polypeptide
EVQLVESGGGLVQPGGSLRLSCAASGRTFSDDTMGWFRQAPGKERELVGTINWSGGSTYYADSVKGRFTISADNSKNTAYLQMNSLKPEDTAVYYCATDPPLFWGQGTLVTVSS

SEQ ID NO: 1237 - protein, 114 aa, Artificial Sequence
  Description of Artificial Sequence: Synthetic polypeptide
EVQLVESGGGLVQPGGSLRLSCAASGRTFGDYIMGWFRQAPGKEREFVAAINWSGGYTPYADSVKGRFTISADNSKNTAYLQMNSLKPEDTAVYYCATDPPLFWGQGTLVTVSS

SEQ ID NO: 1238 - protein, 114 aa, Artificial Sequence
  Description of Artificial Sequence: Synthetic polypeptide
EVQLVESGGGLVQPGGSLRLSCAASGRTFGDDTMGWFRQAPGKERELVAAINWNGGNTHYADSVKGRFTISADNSKNTAYLQMNSLKPEDTAVYYCATDPPLFWGQGTLVTVSS

SEQ ID NO: 1239 - protein, 114 aa, Artificial Sequence
  Description of Artificial Sequence: Synthetic polypeptide
EVQLVESGGGLVQPGGSLRLSCAASGRTFSDDAMGWFRQAPGKEREFVAAINWSGGTTRYADSVKGRFTISADNSKNTAYLQMNSLKPEDTAVYYCATDPPLFWGQGTLVTVSS

SEQ ID NO: 1240 - protein, 120 aa, Artificial Sequence
  Description of Artificial Sequence: Synthetic polypeptide
EVQLVESGGGLVQPGGSLRLSCAASGRTFGDYIMGWFRQAPGKERESVAAINWSAGYTPYADSVKGRFTISADNSKNTAYLQMNSLKPEDTAVYYCATDPPLFWGHVDLWGQGTLVTVSS

SEQ ID NO: 1241 - protein, 114 aa, Artificial Sequence
  Description of Artificial Sequence: Synthetic polypeptide
EVQLVESGGGLVQPGGSLRLSCAASGRTFSDDTMGWFRQAPGKEREWVASINWSGGSTYYADSVKGRFTISADNSKNTAYLQMNSLKPEDTAVYYCATDPPLFWGQGTLVTVSS

SEQ ID NO: 1242 - protein, 114 aa, Artificial Sequence
  Description of Artificial Sequence: Synthetic polypeptide
EVQLVESGGGLVQPGGSLRLSCAASGRTFSDDAMGWFRQAPGKEREFVAGISWNGGSIYYADSVKGRFTISADNSKNTAYLQMNSLKPEDTAVYYCATDPPLFWGQGTLVTVSS

SEQ ID NO: 1243 - protein, 123 aa, Artificial Sequence
  Description of Artificial Sequence: Synthetic polypeptide
EVQLVESGGGLVQPGGSLRLSCAASGFTFDDYEMGWFRQAPGKEREFVAAISWRGGTTYYADSVKGRFTISADNSKNTAYLQMNSLKPEDTAVYYCAADRRGLASTRAGDYDWGQGTLVTVSS

SEQ ID NO: 1244 - protein, 120 aa, Artificial Sequence
  Description of Artificial Sequence: Synthetic polypeptide
EVQLVESGGGLVQPGGSLRLSCAASGRTFGDDTMGWFRQAPGKEREFVAAINWSGGYTPYADSVKGRFTISADNSKNTAYLQMNSLKPEDTAVYYCATDPPLFWGHVDLWGQGTLVTVSS

SEQ ID NO: 1245 - protein, 114 aa, Artificial Sequence
  Description of Artificial Sequence: Synthetic polypeptide
EVQLVESGGGLVQPGGSLRLSCAASGRTFSDDAMGWFRQAPGKEREFVAAINWSGGSTRYADSVKGRFTISADNSKNTAYLQMNSLKPEDTAVYYCATDPPLFWGQGTLVTVSS

SEQ ID NO: 1246 - protein, 128 aa, Artificial Sequence
  Description of Artificial Sequence: Synthetic polypeptide
EVQLVESGGGLVQPGGSLRLSCAASGVTLDDYAMGWFRQAPGKEREFVAVINWSGGSTDYADSVKGRFTISADNSKNTAYLQMNSLKPEDTAVYYCARGGGWVPSSTSESLNWYFDRWGQGTLVTVSS

SEQ ID NO: 1247 - protein, 120 aa, Artificial Sequence
  Description of Artificial Sequence: Synthetic polypeptide
EVQLVESGGGLVQPGGSLRLSCAASGRTFGDYIMGWFRQAPGKERESVAAINWSGGTTPYADSVKGRFTISADNSKNTAYLQMNSLKPEDTAVYYCATDPPLFCCHVDLWGQGTLVTVSS

SEQ ID NO: 1248 - protein, 114 aa, Artificial Sequence
  Description of Artificial Sequence: Synthetic polypeptide
EVQLVESGGGLVQPGGSLRLSCAASGLTFSDDTMGWFRQAPGKEREFVAAVSWSGGNTYYADSVKGRFTISADNSKNTAYLQMNSLKPEDTAVYYCATDPPLFWGQGTLVTVSS

SEQ ID NO: 1249 - protein, 114 aa, Artificial Sequence
  Description of Artificial Sequence: Synthetic polypeptide
EVQLVESGGGLVQPGGSLRLSCAASGRTFGDDTMGWFRQAPGKEREFVAAINWTGGYTPYADSVKGRFTISADNSKNTAYLQMNSLKPEDTAVYYCATDPPLFWGQGTLVTVSS

SEQ ID NO: 1250 - protein, 120 aa, Artificial Sequence
  Description of Artificial Sequence: Synthetic polypeptide
EVQLVESGGGLVQPGGSLRLSCAASGRTFGDYIMGWFRQAPGKEREFVATINWTAGYTYYADSVKGRFTISADNSKNTAYLQMNSLKPEDTAVYYCATDPPLFCWHFDHWGQGTLVTVSS

SEQ ID NO: 1251 - protein, 114 aa, Artificial Sequence
  Description of Artificial Sequence: Synthetic polypeptide
EVQLVESGGGLVQPGGSLRLSCAASGRTFGDDTMGWFRQAPGKEREFVAAINWSGGNTDYADSVKGRFTISADNSKNTAYLQMNSLKPEDTAVYYCATDPPLFWGQGTLVTVSS

SEQ ID NO: 1252 - protein, 114 aa, Artificial Sequence
  Description of Artificial Sequence: Synthetic polypeptide
EVQLVESGGGLVQPGGSLRLSCAASGRTFGDYTMGWFRQAPGKEREFVAAINWSGGNTYYADSVKGRFTISADNSKNTAYLQMNSLKPEDTAVYYCATDPPLFWGQGTLVTVSS

SEQ ID NO: 1253 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAGINWSGNGVYYADSVKGRFTISADNSKNTAYLQMNSLKPEDTAVYYCATDPPLFWGQGTLVTVSS

SEQ ID NO: 1254 - protein, 114 aa, Artificial Sequence
  Description of Artificial Sequence: Synthetic polypeptide
EVQLVESGGGLVQPGGSLRLSCAASGRTFGDYAMGWFRQAPGKERELVAPINWSGGSTYYADSVKGRFTISADNSKNTAYLQMNSLKPEDTAVYYCATDPPLFWGQGTLVTVSS

SEQ ID NO: 1255 - protein, 118 aa, Artificial Sequence
  Description of Artificial Sequence: Synthetic polypeptide
EVQLVESGGGLVQPGGSLRLSCAASGGTFSNSGMGWFRQAPGKERELVAVVNWSGRRTYYADSVKGRFTISADNSKNTAYLQMNSLKPEDTAVYYCAVPWMDYNRRDWGQGTLVTVSS

SEQ ID NO: 1256 - protein, 118 aa, Artificial Sequence
  Description of Artificial Sequence: Synthetic polypeptide
EVQLVESGGGLVQPGGSLRLSCAASGQLANFASYAMGWFRQAPGKEREFVAAITRSGSSTVYADSVKGRFTISADNSKNTAYLQMNSLKPEDTAVYYCATTMNPNPRWGQGTLVTVSS

SEQ ID NO: 1257 - protein, 114 aa, Artificial Sequence
  Description of Artificial Sequence: Synthetic polypeptide
EVQLVESGGGLVQPGGSLRLSCAASGRTFSDDIMGWFRQAPGKEREFVAAINWTGGSTYYADSVKGRFTISADNSKNTAYLQMNSLKPEDTAVYYCATDPPLFWGQGTLVTVSS

SEQ ID NO: 1258 - protein, 120 aa, Artificial Sequence
  Description of Artificial Sequence: Synthetic polypeptide
EVQLVESGGGLVQPGGSLRLSCAASGRTFGDYIMGWFRQAPGKEREIVAAINWSAGYTAYADSVKGRFTISADNSKNTAYLQMNSLKPEDTAVYYCATARPNTGWHFDHWGQGTLVTVSS

SEQ ID NO: 1259 - protein, 114 aa, Artificial Sequence
  Description of Artificial Sequence: Synthetic polypeptide
EVQLVESGGGLVQPGGSLRLSCAASGRTFSDDTMGWFRQAPGKEREWVGSINWSGGSTYYADSVKGRFTISADNSKNTAYLQMNSLKPEDTAVYYCATDPPLFWGQGTLVTVSS

SEQ ID NO: 1260 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAGMTWSGSSTFYADSVKGRFTISADNSKNTAYLQMNSLKPEDTAVYYCATDPPLFWGQGTLVTVSS

SEQ ID NO: 1261 - protein, 114 aa, Artificial Sequence
  Description of Artificial Sequence: Synthetic polypeptide
EVQLVESGGGLVQPGGSLRLSCAASGRTFGDYIMGWFRQAPGKERECVAAINWSGDYTDYADSVKGRFTISADNSKNTAYLQMNSLKPEDTAVYYCATDPPLFWGQGTLVTVSS

SEQ ID NO: 1262 - protein, 114 aa, Artificial Sequence
  Description of Artificial Sequence: Synthetic polypeptide
EVQLVESGGGLVQPGGSLRLSCAASGRTFGDYIMGWFRQAPGKEREFVGGINWSGGYTYYADSVKGRFTISADNSKNTAYLQMNSLKPEDTAVYYCATDPPLFWGQGTLVTVSS

SEQ ID NO: 1263 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAAVNWSGGSTYYADSVKGRFTISADNSKNTAYLQMNSLKPEDTAVYYCATDPPLFWGQGTLVTVSS

SEQ ID NO: 1264 - protein, 114 aa, Artificial Sequence
  Description of Artificial Sequence: Synthetic polypeptide
EVQLVESGGGLVQPGGSLRLSCAASGRTFGDYAMGWFRQAPGKEREFVAAINWSGGYTRYADSVKGRFTISADNSKNTAYLQMNSLKPEDTAVYYCATDPPLFWGQGTLVTVSS

SEQ ID NO: 1265 - protein, 114 aa, Artificial Sequence
  Description of Artificial Sequence: Synthetic polypeptide
EVQLVESGGGLVQPGGSLRLSCAASGRTFGDDTMGWFRQAPGKEREFVAAINWSGGYTPYADSVKGRFTISADNSKNTAYLQMNSLKPEDTAVYYCATDPPLFWGQGTLVTVSS

SEQ ID NO: 1266 - protein, 120 aa, Artificial Sequence
  Description of Artificial Sequence: Synthetic polypeptide
EVQLVESGGGLVQPGGSLRLSCAASGRTFGDYIMGWFRQAPGKERESVAAINWSAGYTAYADSVKGRFTISADNSKNTAYLQMNSLKPEDTAVYYCARASPNTGWHFDRWGQGTLVTVSS

SEQ ID NO: 1267 - protein, 114 aa, Artificial Sequence
  Description of Artificial Sequence: Synthetic polypeptide
EVQLVESGGGLVQPGGSLRLSCAASGRTFGDYIMGWFRQAPGKEREFVAAINWSGGYTHYADSVKGRFTISADNSKNTAYLQMNSLKPEDTAVYYCATDPPLFWGQGTLVTVSS

SEQ ID NO: 1268 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAAITWSGGRTRYADSVKGRFTISADNSKNTAYLQMNSLKPEDTAVYYCATDRPLFWGQGTLVTVSS

SEQ ID NO: 1269 - protein, 120 aa, Artificial Sequence
  Description of Artificial Sequence: Synthetic polypeptide
EVQLVESGGGLVQPGGSLRLSCAASGRTFGDYIMGWFRQAPGKERESVAAINWSGGYTAYADSVKGRFTISADNSKNTAYLQMNSLKPEDTAVYYCATASPNTGWHFDHWGQGTLVTVSS

SEQ ID NO: 1270 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAAIHWSGSSTRYADSVKGRFTISADNSKNTAYLQMNSLKPEDTAVYYCATDPPLFWGQGTLVTVSS

SEQ ID NO: 1271 - protein, 114 aa, Artificial Sequence
  Description of Artificial Sequence: Synthetic polypeptide
EVQLVESGGGLVQPGGSLRLSCAASGRTFSDYTMGWFRQAPGKEREWVAAINWSGGTTYYADSVKGRFTISADNSKNTAYLQMNSLKPEDTAVYYCATDPPLFWGQGTLVTVSS

SEQ ID NO: 1272 - protein, 114 aa, Artificial Sequence
  Description of Artificial Sequence: Synthetic polypeptide
EVQLVESGGGLVQPGGSLRLSCAASGRTFGDDTMGWFRQAPGKEREFVAAINWSGDNTHYADSVKGRFTISADNSKNTAYLQMNSLKPEDTAVYYCATDPPLFWGQGTLVTVSS

SEQ ID NO: 1273 - protein, 118 aa, Artificial Sequence
  Description of Artificial Sequence: Synthetic polypeptide
EVQLVESGGGLVQPGGSLRLSCAASGFAFGDNWIGWFRQAPGKEREWVASISSGGTTAYADNVKGRFTIIADNSKNTAYLQMNSLKPEDTAVYYCAHRGGWLRPWGYWGQGTLVTVSS

SEQ ID NO: 1274 - protein, 114 aa, Artificial Sequence
  Description of Artificial Sequence: Synthetic polypeptide
EVQLVESGGGLVQPGGSLRLSCAASGRTFSDDAMGWFRQAPGKEREFVGRINWSGGNTYYADSVKGRFTISADNSKNTAYLQMNSLKPEDTAVYYCATDPPLFWGQGTLVTVSS

SEQ ID NO: 1275 - protein, 114 aa, Artificial Sequence
  Description of Artificial Sequence: Synthetic polypeptide
EVQLVESGGGLVQPGGSLRLSCAASGRTFSDDTMGWFRQAPGKEREFVGGISWSGGNTYYADSVKGRFTISADNSKNTAYLQMNSLKPEDTAVYYCATDPPLFWGQGTLVTVSS

SEQ ID NO: 1276 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAAINWSGGSTYYADSVKGRFTISADNSKNTAYLQMNSLKPEDTAVYYCATDPPLFWGQGTLVTVSS

SEQ ID NO: 1277 - protein, 114 aa, Artificial Sequence
  Description of Artificial Sequence: Synthetic polypeptide
EVQLVESGGGLVQPGGSLRLSCAASGRTFGDDTMGWFRQAPGKEREFVAAINWSGGYTYYADSVKGRFTISADNSKNTAYLQMNSLKPEDTAVYYCATDPPLFWGQGTLVTVSS

SEQ ID NO: 1278 - protein, 120 aa, Artificial Sequence
  Description of Artificial Sequence: Synthetic polypeptide
EVQLVESGGGLVQPGGSLRLSCAASGRTFGDYIMGWFRQAPGKEREFVAAINWSADYTAYADSVKGRFTISADNSKNTAYLQMNSLKPEDTAVYYCATDPPLFCWHFDHWGQGTLVTVSS

SEQ ID NO: 1279 - protein, 114 aa, Artificial Sequence
  Description of Artificial Sequence: Synthetic polypeptide
EVQLVESGGGLVQPGGSLRLSCAASGRTFSDDAMGWFRQAPGKEREFVAAINWSGSSTYYADSVKGRFTISADNSKNTAYLQMNSLKPEDTAVYYCATDPPLFWGQGTLVTVSS

SEQ ID NO: 1280 - protein, 120 aa, Artificial Sequence
  Description of Artificial Sequence: Synthetic polypeptide
EVQLVESGGGLVQPGGSLRLSCAASGRTFGDYIMGWFRQAPGKEREMVAAINWIAGYTADADSVRRLFTITADNNKNTAHLMMNLLKPENTAVYYCAEPSPNTGWHFDHWGQGTLVTVSS

SEQ ID NO: 1281 - protein, 114 aa, Artificial Sequence
  Description of Artificial Sequence: Synthetic polypeptide
EVQLVESGGGLVQPGGSLRLSCAASGRTFGDDTMGWFRQAPGKEREFVAAINWSGGNTPYADSVKGRFTISADNSKNTAYLQMNSLKPEDTAVYYCATDPPLFWGQGTLVTVSS

SEQ ID NO: 1282 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAAINWSGDNTHYADSVKGRFTISADNSKNTAYLQMNSLKPEDTAVYYCATDPPLFWGQGTLVTVSS

SEQ ID NO: 1283 - protein, 120 aa, Artificial Sequence
  Description of Artificial Sequence: Synthetic polypeptide
EVQLVESGGGLVQPGGSLRLSCAASGRTFGDYIMGWFRQAPGKEREIVAAINWSAGYTAYADSVKGRFTISADNSKNTAYLQMNSLKPEDTAVYYCATAPPLFCWHFDHWGQGTLVTVSS

SEQ ID NO: 1284 - protein, 120 aa, Artificial Sequence
  Description of Artificial Sequence: Synthetic polypeptide
EVQLVESGGGLVQPGGSLRLSCAASGFTFGDYVMGWFRQAPGKEREIVAAINWNAGYTAYADSVRGLFTITADNSKNTAYLQMNSLKPEDTAVYYCAKASPNTGWHFDHWGQGTLVTVSS

SEQ ID NO: 1285 - protein, 114 aa, Artificial Sequence
  Description of Artificial Sequence: Synthetic polypeptide
EVQLVESGGGLVQPGGSLRLSCAASGRTFGDYTMGWFRQAPGKEREFVAAINWTGGYTYYADSVKGRFTISADNSKNTAYLQMNSLKPEDTAVYYCATDPPLFWGQGTLVTVSS

SEQ ID NO: 1286 - protein, 120 aa, Artificial Sequence
  Description of Artificial Sequence: Synthetic polypeptide
EVQLVESGGGLVQPGGSLRLSCAASGRTFGDYIMGWFRQAPGKEREIVAAINWSAGYTAYADSVKGLFTITADNSKNTAYLQMNILKPEDTAVYYCARATPNTGWHFDHWGQGTLVTVSS

SEQ ID NO: 1287 - protein, 114 aa, Artificial Sequence
  Description of Artificial Sequence: Synthetic polypeptide
EVQLVESGGGLVQPGGSLRLSCAASGRTFGDYIMGWFRQAPGKEREFVAAINWSGDNTHYADSVKGRFTISADNSKNTAYLQMNSLKPEDTAVYYCATDPPLFWGQGTLVTVSS

SEQ ID NO: 1288 - protein, 120 aa, Artificial Sequence
  Description of Artificial Sequence: Synthetic polypeptide
EVQLVESGGGLVQPGGSLRLSCAASGRTFGDYIMGWFRQAPGKEREIVAAINWSAGYTPYADSVKGRFTISADNSKNTAYLQMNSLKPEDTAVYYCATDPPLFCCHFDHWGQGTLVTVSS

SEQ ID NO: 1289 - protein, 120 aa, Artificial Sequence
  Description of Artificial Sequence: Synthetic polypeptide
EVQLVESGGGLVQPGGSLRLSCAASGRTFGDYIMGWFRQAPGKERESVAAINWSAGYTAYADSVKGRFTISADNSKNTAYLQMNSLKPEDTAVYYCATAPPNTGWHFDHWGQGTLVTVSS

SEQ ID NO: 1290 - protein, 123 aa, Artificial Sequence
  Description of Artificial Sequence: Synthetic polypeptide
EVQLVESGGGLVQPGGSLRLSCAASGFTWGDYTMGWFRQAPGKEREFVAAINWSGGNTYYADSVKGRFTISADNSKNTAYLQMNSLKPEDTAVYYCAADRRGLASTRAADYDWGQGTLVTVSS

SEQ ID NO: 1291 - protein, 122 aa, Artificial Sequence
  Description of Artificial Sequence: Synthetic polypeptide
EVQLVESGGGLVQPGGSLRLSCAASGIPSTLRAMGWFRQAPGKEREFVAAVSSLGPFTRYADSVKGRFTISADNSKNTAYLQMNSLKPEDTAVYYCAAKPGWVARDPSQYNWGQGTLVTVSS

SEQ ID NO: 1292 - protein, 124 aa, Artificial Sequence
  Description of Artificial Sequence: Synthetic polypeptide
EVQLVESGGGLVQPGGSLRLSCAASGFSFDDDYVMGWFRQAPGKEREFVAAINWSGGSTYYADSVKGRFTISADNSKNTAYLQMNSLKPEDTAVYYCAADRRGLASTRAADYDWGQGTLVTVSS

SEQ ID NO: 1293 - protein, 116 aa, Artificial Sequence
  Description of Artificial Sequence: Synthetic polypeptide
EVQLVESGGGLVQPGGSLRLSCAASGRTFSNAAMGWFRQAPGKEREFVARILWTGASRSYADSVKGRFTISADNSKNTAYLQMNSLKPEDTAVYYCATTENPNPRWGQGTLVTVSS

SEQ ID NO: 1294 - protein, 120 aa, Artificial Sequence
  Description of Artificial Sequence: Synthetic polypeptide
EVQLVESGGGLVQPGGSLRLSCAASGGTFGVYHMGWFRQAPGKEREGVAAINMSGDDSAYADSVKGRFTISADNSKNTAYLQMNSLKPEDTAVYYCAILVGPGQVEFDHWGQGTLVTVSS

SEQ ID NO: 1295 - protein, 124 aa, Artificial Sequence
  Description of Artificial Sequence: Synthetic polypeptide
EVQLVESGGGLVQPGGSLRLSCAASGFTFSSYYMGWFRQAPGKEREFVARISGSTFYADSVKGRFTISADNSKNTAYLQMNSLKPEDTAVYYCAALPFVCPSGSYSDYGDEYDWGQGTLVTVSS

SEQ ID NO: 1296 - protein, 114 aa, Artificial Sequence
  Description of Artificial Sequence: Synthetic polypeptide
EVQLVESGGGLVQPGGSLRLSCAASGRTFSGDFMGWFRQAPGKEREFVGRINWSGGNTYYADSVRGLFTITADNNKNTAYLMMNLLKPEDTAVYYCPTDPPLFWGLGTLVTWSS

SEQ ID NO: 1297 - protein, 119 aa, Artificial Sequence
  Description of Artificial Sequence: Synthetic polypeptide
EVQLVESGGGLVQPGGSLRLSCAASGSTLRDYAMGWFRQAPGKERESVAAITWSGGSTAYADSVKGRFTISADNSKNTAYLQMNSLKPEDTAVYYCASLLAGDRYFDYWGQGTLVTVSS

SEQ ID NO: 1298 - protein, 123 aa, Artificial Sequence
  Description of Artificial Sequence: Synthetic polypeptide
EVQLVESGGGLVQPGGSLRLSCAASGFTFDDYTMGWFRQAPGKEREFVAAITDNGGSKYYADSVKGRFTISADNSKNTAYLQMNSLKPEDTAVYYCAADRRGLASTRAADYDWGQGTLVTVSS

SEQ ID NO: 1299 - protein, 122 aa, Artificial Sequence
  Description of Artificial Sequence: Synthetic polypeptide
EVQLVESGGGLVQPGGSLRLSCAASGGTFSSYGMGWFRQAPGKEREFVAAINWSGASTYYADSVKGRFTISADNSKNTAYLQMNSLKPEDTAVYYCARDWRDRTWGNSLDYWGQGTLVTVSS

SEQ ID NO: 1300 - protein, 124 aa, Artificial Sequence
  Description of Artificial Sequence: Synthetic polypeptide
EVQLVESGGGLVQPGGSLRLSCAASGFSFDDDYVMGWFRQAPGKEREFVAAISWSEDNTYYADSVKGRFTISADNSKNTAYLQMNSLKPEDTAVYYCAADRRGLASTRAADYDWGQGTLVTVSS

SEQ ID NO: 1301 - protein, 124 aa, Artificial Sequence
  Description of Artificial Sequence: Synthetic polypeptide
EVQLVESGGGLVQPGGSLRLSCAASGFSFDDDYVMGWFRQAPGKEREFVAAVSGSGDDTYYADSVKGRFTISADNSKNTAYLQMNSLKPEDTAVYYCAADRRGLASTRAADYDWGQGTLVTVSS

SEQ ID NO: 1302 - protein, 126 aa, Artificial Sequence
  Description of Artificial Sequence: Synthetic polypeptide
EVQLVESGGGLVQPGGSLRLSCAASGNIAAINVMGWFRQAPGKEREFVAAISASGRRTDYADSVKGRFTISADNSKNTAYLQMNSLKPEDTAVYYCARRVYYYDSSGPPGVTFDIWGQGTLVTVSS

SEQ ID NO: 1303 - protein, 118 aa, Artificial Sequence
  Description of Artificial Sequence: Synthetic polypeptide
EVQLVESGGGLVQPGGSLRLSCAASGIITSRYVMGWFRQAPGKEREGVAAISTGGSTIYADSVKGRFTISADNSKNTAYLQMNSLKPEDTAVYYCARQDSSSPYFDYWGQGTLVTVSS

SEQ ID NO: 1304 - protein, 124 aa, Artificial Sequence
  Description of Artificial Sequence: Synthetic polypeptide
EVQLVESGGGLVQPGGSLRLSCAASGFSFDDDYVMGWFRQAPGKEREFVAAISNSGLSTYYADSVKGRFTISADNSKNTAYLQMNSLKPEDTAVYYCAADRRGLASTRAADYDWGQGTLVTVSS

SEQ ID NO: 1305 - protein, 126 aa, Artificial Sequence
  Description of Artificial Sequence: Synthetic polypeptide
EVQLVESGGGLVQPGGSLRLSCAASGSISSINVMGWFRQAPGKEREFVATMRWSTGSTYYADSVKGRFTISADNSKNTAYLQMNSLKPEDTAVYYCAQRVRGFFGPLRTTPSWYEWGQGTLVTVSS

SEQ ID NO: 1306 - protein, 127 aa, Artificial Sequence
  Description of Artificial Sequence: Synthetic polypeptide
EVQLVESGGGLVQPGGSLRLSCAASGLTFILYRMGWFRQAPGKEREFVAAINNFGTTKYADSVKGRFTISADNSKNTAYLQMNSLKPEDTAVYYCARTHYDFWSGYTSRTPNYFDYWGQGTLVTVSS

SEQ ID NO: 1307 - protein, 120 aa, Artificial Sequence
  Description of Artificial Sequence: Synthetic polypeptide
EVQLVESGGGLVQPGGSLRLSCAASGGTFSVYHMGWFRQAPGKEREPVAAISWSGGSTAYADSVKGRFTISADNSKNTAYLQMNSLKPEDTAVYYCAAVNTWTSPSFDSWGQGTLVTVSS

SEQ ID NO: 1308 - protein, 120 aa, Artificial Sequence
  Description of Artificial Sequence: Synthetic polypeptide
EVQLVESGGGLVQPGGSLRLSCAASGRAFSTYGMGWFRQAPGKEREFVAGINWSGDTPYYADSVKGRFTISADNSKNTAYLQMNSLKPEDTAVYYCAREVGPPPGYFDLWGQGTLVTVSS

SEQ ID NO: 1309 - protein, 123 aa, Artificial Sequence
  Description of Artificial Sequence: Synthetic polypeptide
EVQLVESGGGLVQPGGSLRLSCAASGRTFSDIAMGWFRQAPGKEREFVASINWGGGNTYYADSVKGRFTISADNSKNTAYLQMNSLKPEDTAVYYCAAKGIWDYLGRRDFGDWGQGTLVTVSS

SEQ ID NO: 1310 - protein, 116 aa, Artificial Sequence
  Description of Artificial Sequence: Synthetic polypeptide
EVQLVESGGGLVQPGGSLRLSCAASGRTFSSARMGWFRQAPGKEREFVAAISWSGDNTHYADSVKGRFTISADNSKNTAYLQMNSLKPEDTAVYYCATTENPNPRWGQGTLVTVSS

SEQ ID NO: 1311 - protein, 115 aa, Artificial Sequence
  Description of Artificial Sequence: Synthetic polypeptide
EVQLVESGGGLVQPGGSLRLSCAASGFAFSSYAMGWFRQAPGKEREWVATINGDDYTYYADSVKGRFTISADNSKNTAYLQMNSLKPEDTAVYYCVATPGGYGLWGQGTLVTVSS

SEQ ID NO: 1312 - protein, 125 aa, Artificial Sequence
  Description of Artificial Sequence: Synthetic polypeptide
EVQLVESGGGLVQPGGSLRLSCAASGITFRRHDMGWFRQAPGKEREFVAAIRWSSSSTVYADSVKGRFTISADNSKNTAYLQMNSLKPEDTAVYYCAADRGVYGGRWYRTSQYTWGQGTLVTVSS

SEQ ID NO: 1313 - protein, 119 aa, Artificial Sequence
  Description of Artificial Sequence: Synthetic polypeptide
EVQLVESGGGLVQPGGSLRLSCAASGTAASFNPMGWFRQAPGKEREFVAAITSGGSTNYADSVKGRFTISADNSKNTAYLQMNSLKPEDTAVYYCAAIAYEEGVYRWDWGQGTLVTVSS

SEQ ID NO: 1314 - protein, 119 aa, Artificial Sequence
  Description of Artificial Sequence: Synthetic polypeptide
EVQLVESGGGLVQPGGSLRLSCAASGNINIINYMGWFRQAPGKEREGVAAIHWNGDSTAYADSVKGRFTISADNSKNTAYLQMNSLKPEDTAVYYCASGPPYSNYFAYWGQGTLVTVSS

SEQ ID NO: 1315 - protein, 120 aa, Artificial Sequence
  Description of Artificial Sequence: Synthetic polypeptide
EVQLVESGGGLVQPGGSLRLSCAASGFTFDDYAMGWFRQAPGKERESVAAISGSGGSTAYADSVKGRFTISADNSKNTAYLQMNSLKPEDTAVYYCAKIMGSGRPYFDHWGQGTLVTVSS

SEQ ID NO: 1316 - protein, 119 aa, Artificial Sequence
  Description of Artificial Sequence: Synthetic polypeptide
EVQLVESGGGLVQPGGSLRLSCAASGNIFTRNVMGWFRQAPGKEREFVAAITSSGSTNYADSVKGRFTISADNSKNTAYLQMNSLKPEDTAVYYCARPSSDLQGGVDYWGQGTLVTVSS

SEQ ID NO: 1317 - protein, 123 aa, Artificial Sequence
  Description of Artificial Sequence: Synthetic polypeptide
EVQLVESGGGLVQPGGSLRLSCAASGRTFSSIAMGWFRQAPGKEREFVASINWGGGNTIYADSVKGRFTISADNSKNTAYLQMNSLKPEDTAVYYCAAKGIWDYLGRRDFGDWGQGTLVTVSS

SEQ ID NO: 1318 - protein, 122 aa, Artificial Sequence
  Description of Artificial Sequence: Synthetic polypeptide
EVQLVESGGGLVQPGGSLRLSCAASGIPSTLRAMGWFRQAPGKEREFVAAVSSLGPFTRYADSVKGRFTISADNSKNTAYLQMNSLKPEDTAVYYCAAKPGWVARDPSEYNWGQGTLVTVSS

SEQ ID NO: 1319 - protein, 118 aa, Artificial Sequence
  Description of Artificial Sequence: Synthetic polypeptide
EVQLVESGGGLVQPGGSLRLSCAASGFTLDDSAMGWFRQAPGKEREWVAAITNGGSTYYADSVKGRFTISADNSKNTAYLQMNSLKPEDTAVYYCARFARGSPYFDFWGQGTLVTVSS

SEQ ID NO: 1320 - protein, 120 aa, Artificial Sequence
  Description of Artificial Sequence: Synthetic polypeptide
EVQLVESGGGLVQPGGSLRLSCAASGSISSFNAMGWFRQAPGKERESVAAIDWDGSTAYADSVKGRFTISADNSKNTAYLQMNSLKPEDTAVYYCARGGGYYGSGSFEYWGQGTLVTVSS

SEQ ID NO: 1321 - protein, 122 aa, Artificial Sequence
  Description of Artificial Sequence: Synthetic polypeptide
EVQLVESGGGLVQPGGSLRLSCAASGNIFSDNIIGWFRQAPGKEREMVAYYTSGGSIDYADSVKGRFTISADNSKNTAYLQMNSLKPEDTAVYYCARGTAVGRPPPGGMDVWGQGTLVTVSS

SEQ ID NO: 1322 - protein, 119 aa, Artificial Sequence
  Description of Artificial Sequence: Synthetic polypeptide
EVQLVESGGGLVQPGGSLRLSCAASGSISSIGAMGWFRQAPGKEREGVAAISSSGSSTVYADSVKGRFTISADNSKNTAYLQMNSLKPEDTAVYYCARVPPGQAYFDSWGQGTLVTVSS

SEQ ID NO: 1323 - protein, 123 aa, Artificial Sequence
  Description of Artificial Sequence: Synthetic polypeptide
EVQLVESGGGLVQPGGSLRLSCAASGFTFDDYGMGWFRQAPGKERELVATITWSGDSTYYADSVKGRFTISADNSKNTAYLQMNSLKPEDTAVYYCAKGGSWYYDSSGYYGRWGQGTLVTVSS

SEQ ID NO: 1324 - protein, 118 aa, Artificial Sequence
  Description of Artificial Sequence: Synthetic polypeptide
EVQLVESGGGLVQPGGSLRLSCAASGRTFSNYTMGWFRQAPGKEREWVSAISWSTGSTYYADSVKGRFTISADNSKNTAYLQMNSLKPEDTAVYYCAADRYGPPWYDWGQGTLVTVSS

SEQ ID NO: 1325 - protein, 116 aa, Artificial Sequence
  Description of Artificial Sequence: Synthetic polypeptide
EVQLVESGGGLVQPGGSLRLSCAASGSTNYMGWFRQAPGKEREGVAAISMSGDDTIYADSVKGRFTISADNSKNTAYLQMNSLKPEDTAVYYCARIGLRGRYFDLWGQGTLVTVSS

SEQ ID NO: 1326 - protein, 118 aa, Artificial Sequence
  Description of Artificial Sequence: Synthetic polypeptide
EVQLVESGGGLVQPGGSLRLSCAASGGTFSSVGMGWFRQAPGKERELVAVINWSGARTYYADSVKGRFTISADNSKNTAYLQMNSLKPEDTAVYYCAVPWMDYNRRDWGQGTLVTVSS

SEQ ID NO: 1327 - protein, 118 aa, Artificial Sequence
  Description of Artificial Sequence: Synthetic polypeptide
EVQLVESGGGLVQPGGSLRLSCAASGRIFTNTAMGWFRQAPGKEREGVAAINWSGGSTAYADSVKGRFTISADNSKNTAYLQMNSLKPEDTAVYYCARTSGSYSFDYWGQGTLVTVSS

SEQ ID NO: 1328 - protein, 123 aa, Artificial Sequence
  Description of Artificial Sequence: Synthetic polypeptide
EVQLVESGGGLVQPGGSLRLSCAASGEEFSDHWMGWFRQAPGKEREFVGAIHWSGGRTYYADSVKGRFTISADNSKNTAYLQMNSLKPEDTAVYYCAADRRGLASTRAADYDWGQGTLVTVSS

SEQ ID NO: 1329 - protein, 123 aa, Artificial Sequence
  Description of Artificial Sequence: Synthetic polypeptide
EVQLVESGGGLVQPGGSLRLSCAASGRTFSSIAMGWFRQAPGKEREFVAAINWSGARTAYADSVKGRFTISADNSKNTAYLQMNSLKPEDTAVYYCAAKGIWDYLGRRDFGDWGQGTLVTVSS

SEQ ID NO: 1330 - protein, 119 aa, Artificial Sequence
  Description of Artificial Sequence: Synthetic polypeptide
EVQLVESGGGLVQPGGSLRLSCAASGSTSSLRTMGWFRQAPGKEREGVAAISSRDGSTIYADSVKGRFTISADNSKNTAYLQMNSLKPEDTAVYYCARDDSSSPYFDYWGQGTLVTVSS

SEQ ID NO: 1331 - protein, 121 aa, Artificial Sequence
  Description of Artificial Sequence: Synthetic polypeptide
EVQLVESGGGLVQPGGSLRLSCAASGGGTFGSYAMGWFRQAPGKEREFVAAISIASGASGGTTNYADSVKGRFTISADNSKNTAYLQMNSLKPEDTAVYYCATTMNPNPRWGQGTLVTVSS

SEQ ID NO: 1332 - protein, 116 aa, Artificial Sequence
  Description of Artificial Sequence: Synthetic polypeptide
EVQLVESGGGLVQPGGSLRLSCAASGRTFSNAAMGWFRQAPGKEREFVARITWNGGSTFYADSVKGRFTISADNSKNTAYLQMNSLKPEDTAVYYCATTENPNPRWGQGTLVTVSS

SEQ ID NO: 1333 - protein, 123 aa, Artificial Sequence
  Description of Artificial Sequence: Synthetic polypeptide
EVQLVESGGGLVQPGGSLRLSCAASGIILSDNAMGWFRQAPGKEREFVAAISWLGESTYYADSVKGRFTISADNSKNTAYLQMNSLKPEDTAVYYCAADRRGLASTRAADYDWGQGTLVTVSS

SEQ ID NO: 1334 - protein, 120 aa, Artificial Sequence
  Description of Artificial Sequence: Synthetic polypeptide
EVQLVESGGGLVQPGGSLRLSCAASGRTFGDYIMGWFRQAPGKERESVAAINWNGGYTAYADSVKGRFTISADNSKNTAYLQMNSLKPEDTAVYYCATTSPNTGWHYYRWGQGTLVTVSS

SEQ ID NO: 1335 - protein, 128 aa, Artificial Sequence
  Description of Artificial Sequence: Synthetic polypeptide
EVQLVESGGGLVQPGGSLRLSCAASGFNFNWYPMGWFRQAPGKERESVAAISWTGVSTYTAYADSVKGRFTISADNSKNTAYLQMNSLKPEDTAVYYCARWGPGPAGGSPGLVGFDYWGQGTLVTVSS

SEQ ID NO: 1336 - protein, 116 aa, Artificial Sequence
  Description of Artificial Sequence: Synthetic polypeptide
EVQLVESGGGLVQPGGSLRLSCAASGSIRSVSVMGWFRQAPGKEREAVAAISWSGVGTAYADSVKGRFTISADNSKNTAYLQMNSLKPEDTAVYYCAAYQRGWGDWGQGTLVTVSS

SEQ ID NO: 1337 - protein, 122 aa, Artificial Sequence
  Description of Artificial Sequence: Synthetic polypeptide
EVQLVESGGGLVQPGGSLRLSCAASGMTFRLYAMGWFRQAPGKEREFVGAINWLSESTYYADSVKGRFTISADNSKNTAYLQMNSLKPEDTAVYYCAAKPGWVARDPSEYNWGQGTLVTVSS

SEQ ID NO: 1338 - protein, 114 aa, Artificial Sequence
  Description of Artificial Sequence: Synthetic polypeptide
EVQLVESGGGLVQPGGSLRLSCAASGRTFSDDAMGWFRQAPGKEREFVAAINWSGGSTYYADSVKGRFTISADNSKNTAYLQMNSLKPEDTAVYYCATDPPLFWGQGTMVTVSS

SEQ ID NO: 1339 - protein, 125 aa, Artificial Sequence
  Description of Artificial Sequence: Synthetic polypeptide
EVQLVESGGGLVQPGGSLRLSCAASGGTFSVYAMGWFRQAPGKEREGVAAISMSGDDAAYADSVKGRFTISADNSKNTAYLQMNSLKPEDTAVYYCAKISKDDGGKPRGAFFDSWGQGTLVTVSS

SEQ ID NO: 1340 - protein, 120 aa, Artificial Sequence
  Description of Artificial Sequence: Synthetic polypeptide
EVQLVESGGGLVQPGGSLRLSCAASGFALGYYAMGWFRQAPGKERESVAAISSRDGSTAYADSVKGRFTISADNSKNTAYLQMNSLKPEDTAVYYCARLATGPQAYFHHWGQGTLVTVSS

SEQ ID NO: 1341 - protein, 119 aa, Artificial Sequence
  Description of Artificial Sequence: Synthetic polypeptide
EVQLVESGGGLVQPGGSLRLSCAASGFNLDDYAMGWFRQAPGKERESVAAISWDGGATAYADSVKGRFTISADNSKNTAYLQMNSLKPEDTAVYYCARVGRGTTAFDSWGQGTLVTVSS

SEQ ID NO: 1342 - protein, 125 aa, Artificial Sequence
  Description of Artificial Sequence: Synthetic polypeptide
EVQLVESGGGLVQPGGSLRLSCAASGNTFSGGFMGWFRQAPGKEREFVASIRSGARTYYADSVKGRFTISADNSKNTAYLQMNSLKPEDTAVYYCAQRVRGFFGPLRTTPSWYEWGQGTLVTVSS

SEQ ID NO: 1343 - protein, 119 aa, Artificial Sequence
  Description of Artificial Sequence: Synthetic polypeptide
EVQLVESGGGLVQPGGSLRLSCAASGSIRSINIMGWFRQAPGKEREAVAAISWSGGSTVYADSVKGRFTISADNSKNTAYLQMNSLKPEDTAVYYCASLLAGDRYFDYWGQGTLVTVSS

SEQ ID NO: 1344 - protein, 9 aa, Artificial Sequence
  Description of Artificial Sequence: Synthetic peptide
GTFSSIGMG

SEQ ID NO: 1345 - protein, 9 aa, Artificial Sequence
  Description of Artificial Sequence: Synthetic peptide
LRFDDYAMG

SEQ ID NO: 1346 - protein, 9 aa, Artificial Sequence
  Description of Artificial Sequence: Synthetic peptide
SIFSIDVMG

SEQ ID NO: 1347 - protein, 9 aa, Artificial Sequence
  Description of Artificial Sequence: Synthetic peptide
FTLADYAMG

SEQ ID NO: 1348 - protein, 9 aa, Artificial Sequence
  Description of Artificial Sequence: Synthetic peptide
RTFSSIAMG

SEQ ID NO: 1349 - protein, 10 aa, Artificial Sequence
  Description of Artificial Sequence: Synthetic peptide
PTFSSYAMMG

SEQ ID NO: 1350 - protein, 6 aa, Artificial Sequence
  Description of Artificial Sequence: Synthetic peptide
STGYMG

SEQ ID NO: 1351 - protein, 9 aa, Artificial Sequence
  Description of Artificial Sequence: Synthetic peptide
RPFSEYTMG

SEQ ID NO: 1352 - protein, 9 aa, Artificial Sequence
  Description of Artificial Sequence: Synthetic peptide
LTLSTYGMG

SEQ ID NO: 1353 - protein, 9 aa, Artificial Sequence
  Description of Artificial Sequence: Synthetic peptide
FTFNNHNMG

SEQ ID NO: 1354 - protein, 7 aa, Artificial Sequence
  Description of Artificial Sequence: Synthetic peptide
GIYRVMG

SEQ ID NO: 1355 - protein, 9 aa, Artificial Sequence
  Description of Artificial Sequence: Synthetic peptide
YTDSNLWMG

SEQ ID NO: 1356 - protein, 9 aa, Artificial Sequence
  Description of Artificial Sequence: Synthetic peptide
FTFDYYTMG

SEQ ID NO: 1357 - protein, 9 aa, Artificial Sequence
  Description of Artificial Sequence: Synthetic peptide
GIFSINVMG

SEQ ID NO: 1358 - protein, 9 aa, Artificial Sequence
  Description of Artificial Sequence: Synthetic peptide
FTFDGAAMG

SEQ ID NO: 1359 - protein, 9 aa, Artificial Sequence
  Description of Artificial Sequence: Synthetic peptide
RTHSIYPMG

SEQ ID NO: 1360 - protein, 9 aa, Artificial Sequence
  Description of Artificial Sequence: Synthetic peptide
PTFSIYAMG

SEQ ID NO: 1361 - protein, 11 aa, Artificial Sequence
  Description of Artificial Sequence: Synthetic peptide
LTFDDNIHVMG

SEQ ID NO: 1362 - protein, 9 aa, Artificial Sequence
  Description of Artificial Sequence: Synthetic peptide
LTLDYYAMG

SEQ ID NO: 1363 - protein, 9 aa, Artificial Sequence
  Description of Artificial Sequence: Synthetic peptide
RTIVPYTMG

SEQ ID NO: 1364 - protein, 9 aa, Artificial Sequence
  Description of Artificial Sequence: Synthetic peptide
GTFTTYHMG

SEQ ID NO: 1365 - protein, 9 aa, Artificial Sequence
  Description of Artificial Sequence: Synthetic peptide
FTFNVFAMG

SEQ ID NO: 1366 - protein, 9 aa, Artificial Sequence
  Description of Artificial Sequence: Synthetic peptide
SIFSIDVMG

SEQ ID NO: 1367 - protein, 9 aa, Artificial Sequence
  Description of Artificial Sequence: Synthetic peptide
FTFSSYSMG

SEQ ID NO: 1368 - protein, 9 aa, Artificial Sequence
  Description of Artificial Sequence: Synthetic peptide
NTFSINVMG

SEQ ID NO: 1369 - protein, 9 aa, Artificial Sequence
  Description of Artificial Sequence: Synthetic peptide
RTISSYIMG

SEQ ID NO: 1370 - protein, 9 aa, Artificial Sequence
  Description of Artificial Sequence: Synthetic peptide
RANSINWMG

SEQ ID NO: 1371 - protein, 9 aa, Artificial Sequence
  Description of Artificial Sequence: Synthetic peptide
GTFSVFAMG

SEQ ID NO: 1372 - protein, 9 aa, Artificial Sequence
  Description of Artificial Sequence: Synthetic peptide
FTFDDYPMG

SEQ ID NO: 1373 - protein, 9 aa, Artificial Sequence
  Description of Artificial Sequence: Synthetic peptide
FALGYYAMG

SEQ ID NO: 1374 - protein, 9 aa, Artificial Sequence
  Description of Artificial Sequence: Synthetic peptide
RTLDIHVMG

SEQ ID NO: 1375 - protein, 9 aa, Artificial Sequence
  Description of Artificial Sequence: Synthetic peptide
FTPDNYAMG

SEQ ID NO: 1376 - protein, 9 aa, Artificial Sequence
  Description of Artificial Sequence: Synthetic peptide
FTFDDYAMG

SEQ ID NO: 1377 - protein, 9 aa, Artificial Sequence
  Description of Artificial Sequence: Synthetic peptide
RTFSRYIMG

SEQ ID NO: 1378 - protein, 9 aa, Artificial Sequence
  Description of Artificial Sequence: Synthetic peptide
PTFSIYAMG

SEQ ID NO: 1379 - protein, 9 aa, Artificial Sequence
  Description of Artificial Sequence: Synthetic peptide
RTFSLNAMG

SEQ ID NO: 1380 - protein, 9 aa, Artificial Sequence
  Description of Artificial Sequence: Synthetic peptide
STFSINAMG

SEQ ID NO: 1381 - protein, 9 aa, Artificial Sequence
  Description of Artificial Sequence: Synthetic peptide
RTFSMHAMG

SEQ ID NO: 1382 - protein, 9 aa, Artificial Sequence
  Description of Artificial Sequence: Synthetic peptide
VTLDLYAMG

SEQ ID NO: 1383 - protein, 9 aa, Artificial Sequence
  Description of Artificial Sequence: Synthetic peptide
LPFTINVMG

SEQ ID NO: 1384 - protein, 9 aa, Artificial Sequence
  Description of Artificial Sequence: Synthetic peptide
RAFSNYAMG

SEQ ID NO: 1385 - protein, 9 aa, Artificial Sequence
  Description of Artificial Sequence: Synthetic peptide
FTPDDYAMG

SEQ ID NO: 1386 - protein, 9 aa, Artificial Sequence
  Description of Artificial Sequence: Synthetic peptide
FTLNYYGMG

SEQ ID NO: 1387 - protein, 9 aa, Artificial Sequence
  Description of Artificial Sequence: Synthetic peptide
LPFSTKSMG

SEQ ID NO: 1388 - protein, 9 aa, Artificial Sequence
  Description of Artificial Sequence: Synthetic peptide
RTFSINAMG

SEQ ID NO: 1389 - protein, 9 aa, Artificial Sequence
  Description of Artificial Sequence: Synthetic peptide
EEFSDHWMG

SEQ ID NO: 1390 - protein, 9 aa, Artificial Sequence
  Description of Artificial Sequence: Synthetic peptide
FTFGSYDMG

SEQ ID NO: 1391 - protein, 9 aa, Artificial Sequence
  Description of Artificial Sequence: Synthetic peptide
LPLDLYAMG

SEQ ID NO: 1392 - protein, 9 aa, Artificial Sequence
  Description of Artificial Sequence: Synthetic peptide
RTSTVNGMG

SEQ ID NO: 1393 - protein, 9 aa, Artificial Sequence
  Description of Artificial Sequence: Synthetic peptide
FSLDYYGMG

SEQ ID NO: 1394 - protein, 9 aa, Artificial Sequence
  Description of Artificial Sequence: Synthetic peptide
RPNSINWMG

SEQ ID NO: 1395 - protein, 9 aa, Artificial Sequence
  Description of Artificial Sequence: Synthetic peptide
EKFSDHWMG

SEQ ID NO: 1396 - protein, 9 aa, Artificial Sequence
  Description of Artificial Sequence: Synthetic peptide
LTVVPYAMG

SEQ ID NO: 1397 - protein, 9 aa, Artificial Sequence
  Description of Artificial Sequence: Synthetic peptide
TTFNFNVMG

SEQ ID NO: 1398 - protein, 9 aa, Artificial Sequence
  Description of Artificial Sequence: Synthetic peptide
IDVNRNAMG

SEQ ID NO: 1399 - protein, 8 aa, Artificial Sequence
  Description of Artificial Sequence: Synthetic peptide
RTFSSNMG

SEQ ID NO: 1400 - protein, 9 aa, Artificial Sequence
  Description of Artificial Sequence: Synthetic peptide
GTFSMGWIR

SEQ ID NO: 1401 - protein, 9 aa, Artificial Sequence
  Description of Artificial Sequence: Synthetic peptide
CTLDYYAMG

SEQ ID NO: 1402 - protein, 9 aa, Artificial Sequence
  Description of Artificial Sequence: Synthetic peptide
LTFSLYRMC

SEQ ID NO: 1403 - protein, 9 aa, Artificial Sequence
  Description of Artificial Sequence: Synthetic peptide
RSFSSHRMG

SEQ ID NO: 1404 - protein, 9 aa, Artificial Sequence
  Description of Artificial Sequence: Synthetic peptide
RIIVPNTMG

SEQ ID NO: 1405 - protein, 8 aa, Artificial Sequence
  Description of Artificial Sequence: Synthetic peptide
SIFIISMG

SEQ ID NO: 1406 - protein, 9 aa, Artificial Sequence
  Description of Artificial Sequence: Synthetic peptide
FSLDYYDMG

SEQ ID NO: 1407 - protein, 9 aa, Artificial Sequence
  Description of Artificial Sequence: Synthetic peptide
TSISNRVMG

SEQ ID NO: 1408 - protein, 9 aa, Artificial Sequence
  Description of Artificial Sequence: Synthetic peptide
NIDRLYAMG

SEQ ID NO: 1409 - protein, 9 aa, Artificial Sequence
  Description of Artificial Sequence: Synthetic peptide
NTFTINVMG

SEQ ID NO: 1410 - protein, 9 aa, Artificial Sequence
  Description of Artificial Sequence: Synthetic peptide
FNVNDYAMG

SEQ ID NO: 1411 - protein, 9 aa, Artificial Sequence
  Description of Artificial Sequence: Synthetic peptide
FTFDHYTMG

SEQ ID NO: 1412 - protein, 9 aa, Artificial Sequence
  Description of Artificial Sequence: Synthetic peptide
RTFGNYNMG

SEQ ID NO: 1413 - protein, 9 aa, Artificial Sequence
  Description of Artificial Sequence: Synthetic peptide
FTMSSSWMG

SEQ ID NO: 1414 - protein, 9 aa, Artificial Sequence
  Description of Artificial Sequence: Synthetic peptide
FTFSPSWMG

SEQ ID NO: 1415 - protein, 9 aa, Artificial Sequence
  Description of Artificial Sequence: Synthetic peptide
FTRDYYTMG

SEQ ID NO: 1416 - protein, 6 aa, Artificial Sequence
  Description of Artificial Sequence: Synthetic peptide
RTFTMG

SEQ ID NO: 1417 - protein, 9 aa, Artificial Sequence
  Description of Artificial Sequence: Synthetic peptide
TTLDYYAMG

SEQ ID NO: 1418 - protein, 9 aa, Artificial Sequence
  Description of Artificial Sequence: Synthetic peptide
FTFSSYWMG

SEQ ID NO: 1419 - protein, 9 aa, Artificial Sequence
  Description of Artificial Sequence: Synthetic peptide
FTLSGIWMG

SEQ ID NO: 1420 - protein, 9 aa, Artificial Sequence
  Description of Artificial Sequence: Synthetic peptide
FTFDYYAMG

SEQ ID NO: 1421 - protein, 9 aa, Artificial Sequence
  Description of Artificial Sequence: Synthetic peptide
SIASIHAMG

SEQ ID NO: 1422 - protein, 9 aa, Artificial Sequence
  Description of Artificial Sequence: Synthetic peptide
LAFNAYAMG

SEQ ID NO: 1423 - protein, 9 aa, Artificial Sequence
  Description of Artificial Sequence: Synthetic peptide
STYTTYSMG

SEQ ID NO: 1424 - protein, 9 aa, Artificial Sequence
  Description of Artificial Sequence: Synthetic peptide
LTFNDYAMG

SEQ ID NO: 1425 - protein, 9 aa, Artificial Sequence
  Description of Artificial Sequence: Synthetic peptide
ITFRFKAMG

SEQ ID NO: 1426 - protein, 9 aa, Artificial Sequence
  Description of Artificial Sequence: Synthetic peptide
STVLINAMG

SEQ ID NO: 1427 - protein, 9 aa, Artificial Sequence
  Description of Artificial Sequence: Synthetic peptide
FTFDDAAMG

SEQ ID NO: 1428 - protein, 9 aa, Artificial Sequence
  Description of Artificial Sequence: Synthetic peptide
NTGSTGYMG

SEQ ID NO: 1429 - protein, 9 aa, Artificial Sequence
  Description of Artificial Sequence: Synthetic peptide
LTFRNYAMG

SEQ ID NO: 1430 - protein, 9 aa, Artificial Sequence
  Description of Artificial Sequence: Synthetic peptide
SILSIAVMG

SEQ ID NO: 1431 - protein, 9 aa, Artificial Sequence
  Description of Artificial Sequence: Synthetic peptide
STLPYHAMG

SEQ ID NO: 1432 - protein, 9 aa, Artificial Sequence
  Description of Artificial Sequence: Synthetic peptide
TLFKINAMG

SEQ ID NO: 1433 - protein, 9 aa, Artificial Sequence
  Description of Artificial Sequence: Synthetic peptide
RTFSEVVMG

SEQ ID NO: 1434 - protein, 9 aa, Artificial Sequence
  Description of Artificial Sequence: Synthetic peptide
SIFSMNTMG

SEQ ID NO: 1435 - protein, 9 aa, Artificial Sequence
  Description of Artificial Sequence: Synthetic peptide
FTLDYYAMG

SEQ ID NO: 1436 - protein, 9 aa, Artificial Sequence
  Description of Artificial Sequence: Synthetic peptide
LTFGTYTMG

SEQ ID NO: 1437 - protein, 9 aa, Artificial Sequence
  Description of Artificial Sequence: Synthetic peptide
DTFSTSWMG

SEQ ID NO: 1438 - protein, 9 aa, Artificial Sequence
  Description of Artificial Sequence: Synthetic peptide
ITFRFKAMG

SEQ ID NO: 1439 - protein, 9 aa, Artificial Sequence
  Description of Artificial Sequence: Synthetic peptide
DTYGSYWMG

SEQ ID NO: 1440 - protein, 10 aa, Artificial Sequence
  Description of Artificial Sequence: Synthetic peptide
YTLKNYYAMG

SEQ ID NO: 1441 - protein, 9 aa, Artificial Sequence
  Description of Artificial Sequence: Synthetic peptide
FAFGDSWMG

SEQ ID NO: 1442 - protein, 9 aa, Artificial Sequence
  Description of Artificial Sequence: Synthetic peptide
DTFSANRMG

SEQ ID NO: 1443 - protein, 9 aa, Artificial Sequence
  Description of Artificial Sequence: Synthetic peptide
FTLDYYDMG

SEQ ID NO: 1444 - protein, 9 aa, Artificial Sequence
  Description of Artificial Sequence: Synthetic peptide
TFQRINHMG

SEQ ID NO: 1445 - protein, 9 aa, Artificial Sequence
  Description of Artificial Sequence: Synthetic peptide
SAFRSNAMG

SEQ ID NO: 1446 - protein, 9 aa, Artificial Sequence
  Description of Artificial Sequence: Synthetic peptide
FTLAYYAMG

SEQ ID NO: 1447 - protein, 9 aa, Artificial Sequence
  Description of Artificial Sequence: Synthetic peptide
FDFSVSWMG

SEQ ID NO: 1448 - protein, 9 aa, Artificial Sequence
  Description of Artificial Sequence: Synthetic peptide
HTFSTSWMG

SEQ ID NO: 1449 - protein, 9 aa, Artificial Sequence
  Description of Artificial Sequence: Synthetic peptide
NTFSGGFMG

SEQ ID NO: 1450 - protein, 9 aa, Artificial Sequence
  Description of Artificial Sequence: Synthetic peptide
FTFSPSWMG

SEQ ID NO: 1451 - protein, 9 aa, Artificial Sequence
  Description of Artificial Sequence: Synthetic peptide
FTFSDYWMG

SEQ ID NO: 1452 - protein, 9 aa, Artificial Sequence
  Description of Artificial Sequence: Synthetic peptide
FTFSTSWMG

SEQ ID NO: 1453 - protein, 9 aa, Artificial Sequence
  Description of Artificial Sequence: Synthetic peptide
DTYGSYWMG

SEQ ID NO: 1454 - protein, 10 aa, Artificial Sequence
  Description of Artificial Sequence: Synthetic peptide
RTFSSYAMMG

SEQ ID NO: 1455 - protein, 9 aa, Artificial Sequence
  Description of Artificial Sequence: Synthetic peptide
GTFGVYHMG

SEQ ID NO: 1456 - protein, 9 aa, Artificial Sequence
  Description of Artificial Sequence: Synthetic peptide
NMFSINAMG

SEQ ID NO: 1457 - protein, 7 aa, Artificial Sequence
  Description of Artificial Sequence: Synthetic peptide
LTFSAMG

SEQ ID NO: 1458 - protein, 9 aa, Artificial Sequence
  Description of Artificial Sequence: Synthetic peptide
RTFSMHAMG

SEQ ID NO: 1459 - protein, 9 aa, Artificial Sequence
  Description of Artificial Sequence: Synthetic peptide
FTVSNYAMG

SEQ ID NO: 1460 - protein, 9 aa, Artificial Sequence
  Description of Artificial Sequence: Synthetic peptide
STVLINAMG

SEQ ID NO: 1461 - protein, 9 aa, Artificial Sequence
  Description of Artificial Sequence: Synthetic peptide
FSFDRWAMG

SEQ ID NO: 1462 - protein, 9 aa, Artificial Sequence
  Description of Artificial Sequence: Synthetic peptide
YTYSSYVMG

SEQ ID NO: 1463 - protein, 9 aa, Artificial Sequence
  Description of Artificial Sequence: Synthetic peptide
DTYGSYWMG

SEQ ID NO: 1464 - protein, 9 aa, Artificial Sequence
  Description of Artificial Sequence: Synthetic peptide
ISINTNVMG

SEQ ID NO: 1465 - protein, 9 aa, Artificial Sequence
  Description of Artificial Sequence: Synthetic peptide
FEFENHWMG

SEQ ID NO: 1466 - protein, 9 aa, Artificial Sequence
  Description of Artificial Sequence: Synthetic peptide
FTMSSSWMG

SEQ ID NO: 1467 - protein, 8 aa, Artificial Sequence
  Description of Artificial Sequence: Synthetic peptide
NIFRSNMG

SEQ ID NO: 1468 - protein, 9 aa, Artificial Sequence
  Description of Artificial Sequence: Synthetic peptide
LTFDDHSMG

SEQ ID NO: 1469 - protein, 9 aa, Artificial Sequence
  Description of Artificial Sequence: Synthetic peptide
RAVSTYAMG

SEQ ID NO: 1470 - protein, 12 aa, Artificial Sequence
  Description of Artificial Sequence: Synthetic peptide
ISGSVFSRTPMG

SEQ ID NO: 1471 - protein, 9 aa, Artificial Sequence
  Description of Artificial Sequence: Synthetic peptide
DTYGSYWMG

SEQ ID NO: 1472 - protein, 9 aa, Artificial Sequence
  Description of Artificial Sequence: Synthetic peptide
DTYGSYWMG

SEQ ID NO: 1473 - protein, 9 aa, Artificial Sequence
  Description of Artificial Sequence: Synthetic peptide
STFSGNWMG

SEQ ID NO: 1474 - protein, 6 aa, Artificial Sequence
  Description of Artificial Sequence: Synthetic peptide
QTFNMG

SEQ ID NO: 1475 - protein, 8 aa, Artificial Sequence
  Description of Artificial Sequence: Synthetic peptide
IPSIHAMG

SEQ ID NO: 1476 - protein, 9 aa, Artificial Sequence
  Description of Artificial Sequence: Synthetic peptide
LPFSTLHMG

SEQ ID NO: 1477 - protein, 9 aa, Artificial Sequence
  Description of Artificial Sequence: Synthetic peptide
LTFSLFAMG

SEQ ID NO: 1478 - protein, 8 aa, Artificial Sequence
  Description of Artificial Sequence: Synthetic peptide
SFSNYAMG

SEQ ID NO: 1479 - protein, 9 aa, Artificial Sequence
  Description of Artificial Sequence: Synthetic peptide
FTLSDRAMG

SEQ ID NO: 1480 - protein, 9 aa, Artificial Sequence
  Description of Artificial Sequence: Synthetic peptide
GTFSSVGMG

SEQ ID NO: 1481 - protein, 10 aa, Artificial Sequence
  Description of Artificial Sequence: Synthetic peptide
FNLDDYADMG

SEQ ID NO: 1482 - protein, 9 aa, Artificial Sequence
  Description of Artificial Sequence: Synthetic peptide
ITFSNDAMG

SEQ ID NO: 1483 - protein, 9 aa, Artificial Sequence
  Description of Artificial Sequence: Synthetic peptide
STLSINAMG

SEQ ID NO: 1484 - protein, 9 aa, Artificial Sequence
  Description of Artificial Sequence: Synthetic peptide
HTFSGYAMG

SEQ ID NO: 1485 - protein, 9 aa, Artificial Sequence
  Description of Artificial Sequence: Synthetic peptide
FAFGDSWMG

SEQ ID NO: 1486 - protein, 9 aa, Artificial Sequence
  Description of Artificial Sequence: Synthetic peptide
GTFSTYWMG

SEQ ID NO: 1487 - protein, 9 aa, Artificial Sequence
  Description of Artificial Sequence: Synthetic peptide
LAFDFDGMG

SEQ ID NO: 1488 - protein, 9 aa, Artificial Sequence
  Description of Artificial Sequence: Synthetic peptide
FTFDRSWMG

SEQ ID NO: 1489 - protein, 7 aa, Artificial Sequence
  Description of Artificial Sequence: Synthetic peptide
RTYDAMG

SEQ ID NO: 1490 - protein, 9 aa, Artificial Sequence
  Description of Artificial Sequence: Synthetic peptide
SISSIDYMG

SEQ ID NO: 1491 - protein, 9 aa, Artificial Sequence
  Description of Artificial Sequence: Synthetic peptide
GTFSFYNMG

SEQ ID NO: 1492 - protein, 9 aa, Artificial Sequence
  Description of Artificial Sequence: Synthetic peptide
FIGNYHAMG

SEQ ID NO: 1493 - protein, 9 aa, Artificial Sequence
  Description of Artificial Sequence: Synthetic peptide
SSLDAYGMG

SEQ ID NO: 1494 - protein, 9 aa, Artificial Sequence
  Description of Artificial Sequence: Synthetic peptide
SIASIHAMG

SEQ ID NO: 1495 - protein, 9 aa, Artificial Sequence
  Description of Artificial Sequence: Synthetic peptide
FTPDDYAMG

SEQ ID NO: 1496 - protein, 9 aa, Artificial Sequence
  Description of Artificial Sequence: Synthetic peptide
GTFSVFAMG

SEQ ID NO: 1497 - protein, 9 aa, Artificial Sequence
  Description of Artificial Sequence: Synthetic peptide
PISGINRMG

SEQ ID NO: 1498 - protein, 9 aa, Artificial Sequence
  Description of Artificial Sequence: Synthetic peptide
TSIMVGAMG

SEQ ID NO: 1499 - protein, 9 aa, Artificial Sequence
  Description of Artificial Sequence: Synthetic peptide
RTFSTHWMG

SEQ ID NO: 1500 - protein, 8 aa, Artificial Sequence
  Description of Artificial Sequence: Synthetic peptide
TIFASAMG

SEQ ID NO: 1501 - protein, 9 aa, Artificial Sequence
  Description of Artificial Sequence: Synthetic peptide
FPFSIWPMG

SEQ ID NO: 1502 - protein, 9 aa, Artificial Sequence
  Description of Artificial Sequence: Synthetic peptide
RTFGNYAMG

SEQ ID NO: 1503 - protein, 10 aa, Artificial Sequence
  Description of Artificial Sequence: Synthetic peptide
FLFDSYASMG

SEQ ID NO: 1504 - protein, 9 aa, Artificial Sequence
  Description of Artificial Sequence: Synthetic peptide
LPFSTKSMG

SEQ ID NO: 1505 - protein, 9 aa, Artificial Sequence
  Description of Artificial Sequence: Synthetic peptide
NIFRIETMG

SEQ ID NO: 1506 - protein, 9 aa, Artificial Sequence
  Description of Artificial Sequence: Synthetic peptide
IPSSIRAMG

SEQ ID NO: 1507 - protein, 9 aa, Artificial Sequence
  Description of Artificial Sequence: Synthetic peptide
FTLSGNWMG

SEQ ID NO: 1508 - protein, 9 aa, Artificial Sequence
  Description of Artificial Sequence: Synthetic peptide
FTFSSLAMG

SEQ ID NO: 1509 - protein, 8 aa, Artificial Sequence
  Description of Artificial Sequence: Synthetic peptide
TFGHYAMG

SEQ ID NO: 1510 - protein, 9 aa, Artificial Sequence
  Description of Artificial Sequence: Synthetic peptide
IPFRSRTMG

SEQ ID NO: 1511 - protein, 9 aa, Artificial Sequence
  Description of Artificial Sequence: Synthetic peptide
GTFSTSWMG

SEQ ID NO: 1512 - protein, 9 aa, Artificial Sequence
  Description of Artificial Sequence: Synthetic peptide
GTFSLFAMG

SEQ ID NO: 1513 - protein, 9 aa, Artificial Sequence
  Description of Artificial Sequence: Synthetic peptide
SSFSAYAMG

SEQ ID NO: 1514 - protein, 9 aa, Artificial Sequence
  Description of Artificial Sequence: Synthetic peptide
RTSSPIAMG

SEQ ID NO: 1515 - protein, 9 aa, Artificial Sequence
  Description of Artificial Sequence: Synthetic peptide
LTFNQYTMG

SEQ ID NO: 1516 - protein, 7 aa, Artificial Sequence
  Description of Artificial Sequence: Synthetic peptide
PTFSSMG

SEQ ID NO: 1517 - protein, 9 aa, Artificial Sequence
  Description of Artificial Sequence: Synthetic peptide
IPSTLRAMG

SEQ ID NO: 1518 - protein, 10 aa, Artificial Sequence
  Description of Artificial Sequence: Synthetic peptide
GVGFSVTNMG

SEQ ID NO: 1519 - protein, 9 aa, Artificial Sequence
  Description of Artificial Sequence: Synthetic peptide
GTFGSYGMG

SEQ ID NO: 1520 - protein, 9 aa, Artificial Sequence
  Description of Artificial Sequence: Synthetic peptide
GTFSTYAMG

SEQ ID NO: 1521 - protein, 9 aa, Artificial Sequence
  Description of Artificial Sequence: Synthetic peptide
PIYAVNRMG

SEQ ID NO: 1522 - protein, 9 aa, Artificial Sequence
  Description of Artificial Sequence: Synthetic peptide
FTFSNYWMG

SEQ ID NO: 1523 - protein, 9 aa, Artificial Sequence
  Description of Artificial Sequence: Synthetic peptide
GTFSAYHMG

SEQ ID NO: 1524 - protein, 13 aa, Artificial Sequence
  Description of Artificial Sequence: Synthetic peptide
AAISWDGGATAYA

SEQ ID NO: 1525 - protein, 12 aa, Artificial Sequence
  Description of Artificial Sequence: Synthetic peptide
AIKFSGGTTDYA

SEQ ID NO: 1526 - protein, 13 aa, Artificial Sequence
  Description of Artificial Sequence: Synthetic peptide
AGISWSGDSTLYA

SEQ ID NO: 1527 - protein, 13 aa, Artificial Sequence
  Description of Artificial Sequence: Synthetic peptide
AVITCSGGSTDYA

SEQ ID NO: 1528 - protein, 18 aa, Artificial Sequence
  Description of Artificial Sequence: Synthetic peptide
AEITEGGISPSGDNIYYA

SEQ ID NO: 1529 - protein, 12 aa, Artificial Sequence
  Description of Artificial Sequence: Synthetic peptide
AAINNFGTTKYA

SEQ ID NO: 1530 - protein, 12 aa, Artificial Sequence
  Description of Artificial Sequence: Synthetic peptide
AAIHSGGSTNYA

SEQ ID NO: 1531 - protein, 13 aa, Artificial Sequence
  Description of Artificial Sequence: Synthetic peptide
SSIHWGGRGTNYA

SEQ ID NO: 1532 - protein, 13 aa, Artificial Sequence
  Description of Artificial Sequence: Synthetic peptide
AHIPRSTYSPYYA

SEQ ID NO: 1533 - protein, 12 aa, Artificial Sequence
  Description of Artificial Sequence: Synthetic peptide
AAISSYSHTAYA

SEQ ID NO: 1534 - protein, 12 aa, Artificial Sequence
  Description of Artificial Sequence: Synthetic peptide
ASISSGGGINYA

SEQ ID NO: 1535 - protein, 12 aa, Artificial Sequence
  Description of Artificial Sequence: Synthetic peptide
AINRSTGSTSYA

SEQ ID NO: 1536 - protein, 12 aa, Artificial Sequence
  Description of Artificial Sequence: Synthetic peptide
AAIRSSGGLFYA

SEQ ID NO: 1537 - protein, 13 aa, Artificial Sequence
  Description of Artificial Sequence: Synthetic peptide
SAIRWNGGNTAYA

SEQ ID NO: 1538 - protein, 12 aa, Artificial Sequence
  Description of Artificial Sequence: Synthetic peptide
ATIRWTNSTDYA

SEQ ID NO: 1539 - protein, 12 aa, Artificial Sequence
  Description of Artificial Sequence: Synthetic peptide
AAIHSGGATVYA

SEQ ID NO: 1540 - protein, 13 aa, Artificial Sequence
  Description of Artificial Sequence: Synthetic peptide
AGIRWSDVYTQYA

SEQ ID NO: 1541 - protein, 13 aa, Artificial Sequence
  Description of Artificial Sequence: Synthetic peptide
AAIHWSGGSTIYA

SEQ ID NO: 1542 - protein, 13 aa, Artificial Sequence
  Description of Artificial Sequence: Synthetic peptide
ASINWSGGSTYYA

SEQ ID NO: 1543 - protein, 12 aa, Artificial Sequence
  Description of Artificial Sequence: Synthetic peptide
AAISPSAFTEYA

SEQ ID NO: 1544 - protein, 12 aa, Artificial Sequence
  Description of Artificial Sequence: Synthetic peptide
AHISTGGATNYA

SEQ ID NO: 1545 - protein, 13 aa, Artificial Sequence
  Description of Artificial Sequence: Synthetic peptide
AAINWSDSRTDYA

SEQ ID NO: 1546 - protein, 13 aa, Artificial Sequence
  Description of Artificial Sequence: Synthetic peptide
AAISWSGESTLYA

SEQ ID NO: 1547 - protein, 12 aa, Artificial Sequence
  Description of Artificial Sequence: Synthetic peptide
AAISSYSHTAYA

SEQ ID NO: 1548 - protein, 13 aa, Artificial Sequence
  Description of Artificial Sequence: Synthetic peptide
AAIHWSGDSTLYA

SEQ ID NO: 1549 - protein, 12 aa, Artificial Sequence
  Description of Artificial Sequence: Synthetic peptide
ARIYTGGDTIYA

SEQ ID NO: 1550 - protein, 12 aa, Artificial Sequence
  Description of Artificial Sequence: Synthetic peptide
ATITPGGNTNYA

SEQ ID NO: 1551 - protein, 12 aa, Artificial Sequence
  Description of Artificial Sequence: Synthetic peptide
AEITAGGSTYYA

SEQ ID NO: 1552 - protein, 12 aa, Artificial Sequence
  Description of Artificial Sequence: Synthetic peptide
ASVLRGGYTWYA

SEQ ID NO: 1553 - protein, 13 aa, Artificial Sequence
  Description of Artificial Sequence: Synthetic peptide
AGIRWTDAYTEYA

SEQ ID NO: 1554 - protein, 13 aa, Artificial Sequence
  Description of Artificial Sequence: Synthetic peptide
AVINWTGESTLYA

SEQ ID NO: 1555 - protein, 15 aa, Artificial Sequence
  Description of Artificial Sequence: Synthetic peptide
AALGWSGVTTYHYYA

SEQ ID NO: 1556 - protein, 13 aa, Artificial Sequence
  Description of Artificial Sequence: Synthetic peptide
ATIMWSGNTTYYA

SEQ ID NO: 1557 - protein, 14 aa, Artificial Sequence
  Description of Artificial Sequence: Synthetic peptide
AAISWSGGDNTYYA

SEQ ID NO: 1558 - protein, 13 aa, Artificial Sequence
  Description of Artificial Sequence: Synthetic peptide
AGISWNGGSTNYA

SEQ ID NO: 1559 - protein, 12 aa, Artificial Sequence
  Description of Artificial Sequence: Synthetic peptide
AAISCGGGSTYA

SEQ ID NO: 1560 - protein, 13 aa, Artificial Sequence
  Description of Artificial Sequence: Synthetic peptide
GGISRSGATTNYA

SEQ ID NO: 1561 - protein, 12 aa, Artificial Sequence
  Description of Artificial Sequence: Synthetic peptide
ASISSQGRTNYA

SEQ ID NO: 1562 - protein, 13 aa, Artificial Sequence
  Description of Artificial Sequence: Synthetic peptide
AGIRWTDAYTEYA

SEQ ID NO: 1563 - protein, 13 aa, Artificial Sequence
  Description of Artificial Sequence: Synthetic peptide
AAIHWSGLTTFYA

SEQ ID NO: 1564 - protein, 20 aa, Artificial Sequence
  Description of Artificial Sequence: Synthetic peptide
AWINNRGTTDYADSGSTYYA

SEQ ID NO: 1565 - protein, 16 aa, Artificial Sequence
  Description of Artificial Sequence: Synthetic peptide
ASIGYSGRSNSYNYYA

SEQ ID NO: 1566 - protein, 12 aa, Artificial Sequence
  Description of Artificial Sequence: Synthetic peptide
AAITSGGAPHYA

SEQ ID NO: 1567 - protein, 12 aa, Artificial Sequence
  Description of Artificial Sequence: Synthetic peptide
AAIHWSGLTSYA

SEQ ID NO: 1568 - protein, 13 aa, Artificial Sequence
  Description of Artificial Sequence: Synthetic peptide
AAISWSGESTQYA

SEQ ID NO: 1569 - protein, 15 aa, Artificial Sequence
  Description of Artificial Sequence: Synthetic peptide
AAIHWSGDSTHRNYA

SEQ ID NO: 1570 - protein, 13 aa, Artificial Sequence
  Description of Artificial Sequence: Synthetic peptide
TAINWSGARTAYA

SEQ ID NO: 1571 - protein, 13 aa, Artificial Sequence
  Description of Artificial Sequence: Synthetic peptide
AGIRWSDAYTEYA

SEQ ID NO: 1572 - protein, 13 aa, Artificial Sequence
  Description of Artificial Sequence: Synthetic peptide
ASISQSGAATAYA

SEQ ID NO: 1573 - protein, 12 aa, Artificial Sequence
  Description of Artificial Sequence: Synthetic peptide
AAITSGGTPHYA

SEQ ID NO: 1574 - protein, 12 aa, Artificial Sequence
  Description of Artificial Sequence: Synthetic peptide
ATITPGGNTNYA

SEQ ID NO: 1575 - protein, 13 aa, Artificial Sequence
  Description of Artificial Sequence: Synthetic peptide
ATITFSGARTAYA

SEQ ID NO: 1576 - protein, 12 aa, Artificial Sequence
  Description of Artificial Sequence: Synthetic peptide
AAIRRSAVTNYA

SEQ ID NO: 1577 - protein, 13 aa, Artificial Sequence
  Description of Artificial Sequence: Synthetic peptide
AVISWTGESTLYA

SEQ ID NO: 1578 - protein, 13 aa, Artificial Sequence
  Description of Artificial Sequence: Synthetic peptide
AAITWSGGWRYYA

SEQ ID NO: 1579 - protein, 12 aa, Artificial Sequence
  Description of Artificial Sequence: Synthetic peptide
ARIFGGDRTLYA

SEQ ID NO: 1580 - protein, 10 aa, Artificial Sequence
  Description of Artificial Sequence: Synthetic peptide
GCIGWITYYA

SEQ ID NO: 1581 - protein, 13 aa, Artificial Sequence
  Description of Artificial Sequence: Synthetic peptide
AGIRWTDAYTEYA

SEQ ID NO: 1582 - protein, 13 aa, Artificial Sequence
  Description of Artificial Sequence: Synthetic peptide
SCISNIDGSTYYA

SEQ ID NO: 1583 - protein, 13 aa, Artificial Sequence
  Description of Artificial Sequence: Synthetic peptide
AAIMWSGSHRNYA

SEQ ID NO: 1584 - protein, 12 aa, Artificial Sequence
  Description of Artificial Sequence: Synthetic peptide
TGISPSAFTEYA

SEQ ID NO: 1585 - protein, 13 aa, Artificial Sequence
  Description of Artificial Sequence: Synthetic peptide
TGINWSGGSTTYA

SEQ ID NO: 1586 - protein, 13 aa, Artificial Sequence
  Description of Artificial Sequence: Synthetic peptide
AALGWSGGSTDYA

SEQ ID NO: 1587 - protein, 12 aa, Artificial Sequence
  Description of Artificial Sequence: Synthetic peptide
ARIYTGGDTLYA

SEQ ID NO: 1588 - protein, 12 aa, Artificial Sequence
  Description of Artificial Sequence: Synthetic peptide
AAIDSDGSTDYA

SEQ ID NO: 1589 - protein, 13 aa, Artificial Sequence
  Description of Artificial Sequence: Synthetic peptide
AAINWNGGTTLYA

SEQ ID NO: 1590 - protein, 13 aa, Artificial Sequence
  Description of Artificial Sequence: Synthetic peptide
AGITSSVGVTNYA

SEQ ID NO: 1591 - protein, 13 aa, Artificial Sequence
  Description of Artificial Sequence: Synthetic peptide
AAISGSENVTSYA

SEQ ID NO: 1592 - protein, 12 aa, Artificial Sequence
  Description of Artificial Sequence: Synthetic peptide
ATINSLGGTSYA

SEQ ID NO: 1593 - protein, 11 aa, Artificial Sequence
  Description of Artificial Sequence: Synthetic peptide
TVISGVGTSYA

SEQ ID NO: 1594 - protein, 12 aa, Artificial Sequence
  Description of Artificial Sequence: Synthetic peptide
ATINEYGGRNYA

SEQ ID NO: 1595 - protein, 13 aa, Artificial Sequence
  Description of Artificial Sequence: Synthetic peptide
AAISRSGSLTSYA

SEQ ID NO: 1596 - protein, 12 aa, Artificial Sequence
  Description of Artificial Sequence: Synthetic peptide
ASTNSAGSTNYA

SEQ ID NO: 1597 - protein, 13 aa, Artificial Sequence
  Description of Artificial Sequence: Synthetic peptide
AAISWSGGSTAYA

SEQ ID NO: 1598 - protein, 12 aa, Artificial Sequence
  Description of Artificial Sequence: Synthetic peptide
ATINWSGVTAYA

SEQ ID NO: 1599 - protein, 12 aa, Artificial Sequence
  Description of Artificial Sequence: Synthetic peptide
AIITTGGRTTYA

SEQ ID NO: 1600 - protein, 12 aa, Artificial Sequence
  Description of Artificial Sequence: Synthetic peptide
SAIDSEGRTSYA

SEQ ID NO: 1601 - protein, 13 aa, Artificial Sequence
  Description of Artificial Sequence: Synthetic peptide
AAISRSGGFGSYA

SEQ ID NO: 1602 - protein, 13 aa, Artificial Sequence
  Description of Artificial Sequence: Synthetic peptide
ATIGWSGANTYYA

SEQ ID NO: 1603 - protein, 13 aa, Artificial Sequence
  Description of Artificial Sequence: Synthetic peptide
AAISGSENVTSYA

SEQ ID NO: 1604 - protein, 13 aa, Artificial Sequence
  Description of Artificial Sequence: Synthetic peptide
AHIPRSTYSPYYA

SEQ ID NO: 1605 - protein, 13 aa, Artificial Sequence
  Description of Artificial Sequence: Synthetic peptide
AAVSWDGRNTYYA

SEQ ID NO: 1606 - protein, 13 aa, Artificial Sequence
  Description of Artificial Sequence: Synthetic peptide
AAVRWSDDYTYYA

SEQ ID NO: 1607 - protein, 13 aa, Artificial Sequence
  Description of Artificial Sequence: Synthetic peptide
AHISWSGGSTYYA

SEQ ID NO: 1608 - protein, 12 aa, Artificial Sequence
  Description of Artificial Sequence: Synthetic peptide
AGVINDGSTVYA

SEQ ID NO: 1609 - protein, 13 aa, Artificial Sequence
  Description of Artificial Sequence: Synthetic peptide
AGMMWSGGTTTYA

SEQ ID NO: 1610 - protein, 13 aa, Artificial Sequence
  Description of Artificial Sequence: Synthetic peptide
AAISPSAVTTYYA

SEQ ID NO: 1611 - protein, 13 aa, Artificial Sequence
  Description of Artificial Sequence: Synthetic peptide
AAITWNGASTSYA

SEQ ID NO: 1612 - protein, 16 aa, Artificial Sequence
  Description of Artificial Sequence: Synthetic peptide
AAITSSGSNIDYTYYA

SEQ ID NO: 1613 - protein, 12 aa, Artificial Sequence
  Description of Artificial Sequence: Synthetic peptide
ATIHSSGSTSYA

SEQ ID NO: 1614 - protein, 13 aa, Artificial Sequence
  Description of Artificial Sequence: Synthetic peptide
ALINRSGGGINYA

SEQ ID NO: 1615 - protein, 13 aa, Artificial Sequence
  Description of Artificial Sequence: Synthetic peptide
AAINWSGDNTHYA

SEQ ID NO: 1616 - protein, 12 aa, Artificial Sequence
  Description of Artificial Sequence: Synthetic peptide
AAISRFGSTYYA

SEQ ID NO: 1617 - protein, 12 aa, Artificial Sequence
  Description of Artificial Sequence: Synthetic peptide
ATINTGGGTNYA

SEQ ID NO: 1618 - protein, 12 aa, Artificial Sequence
  Description of Artificial Sequence: Synthetic peptide
ASISRSGTTYYA

SEQ ID NO: 1619 - protein, 12 aa, Artificial Sequence
  Description of Artificial Sequence: Synthetic peptide
ATITSDDRTNYA

SEQ ID NO: 1620 - protein, 13 aa, Artificial Sequence
  Description of Artificial Sequence: Synthetic peptide
AAIIWTGESTLDA

SEQ ID NO: 1621 - protein, 12 aa, Artificial Sequence
  Description of Artificial Sequence: Synthetic peptide
ATINWSGVTAYA

SEQ ID NO: 1622 - protein, 13 aa, Artificial Sequence
  Description of Artificial Sequence: Synthetic peptide
ASITWSSANTYYA

SEQ ID NO: 1623 - protein, 13 aa, Artificial Sequence
  Description of Artificial Sequence: Synthetic peptide
ALISWSGGSTYYA

SEQ ID NO: 1624 - protein, 12 aa, Artificial Sequence
  Description of Artificial Sequence: Synthetic peptide
ATINTGGQPNYA

SEQ ID NO: 1625 - protein, 13 aa, Artificial Sequence
  Description of Artificial Sequence: Synthetic peptide
AHISWSSKSTYYA

SEQ ID NO: 1626 - protein, 13 aa, Artificial Sequence
  Description of Artificial Sequence: Synthetic peptide
AAISMSGDDTIYA

SEQ ID NO: 1627 - protein, 13 aa, Artificial Sequence
  Description of Artificial Sequence: Synthetic peptide
TAITWSGDSTNYA

SEQ ID NO: 1628 - protein, 12 aa, Artificial Sequence
  Description of Artificial Sequence: Synthetic peptide
ATINSLGGTNYA

SEQ ID NO: 1629 - protein, 12 aa, Artificial Sequence
  Description of Artificial Sequence: Synthetic peptide
AVISSLSSKSYA

SEQ ID NO: 1630 - protein, 13 aa, Artificial Sequence
  Description of Artificial Sequence: Synthetic peptide
AAISWSGGSTAYA

SEQ ID NO: 1631 - protein, 13 aa, Artificial Sequence
  Description of Artificial Sequence: Synthetic peptide
ARVWWNGGSAYYA

SEQ ID NO: 1632 - protein, 12 aa, Artificial Sequence
  Description of Artificial Sequence: Synthetic peptide
ASINEYGGRNYA

SEQ ID NO: 1633 - protein, 12 aa, Artificial Sequence
  Description of Artificial Sequence: Synthetic peptide
AVITSGGSTNYA

SEQ ID NO: 1634 - protein, 13 aa, Artificial Sequence
  Description of Artificial Sequence: Synthetic peptide
ASVNWDASQINYA

SEQ ID NO: 1635 - protein, 13 aa, Artificial Sequence
  Description of Artificial Sequence: Synthetic peptide
GRITWTDGSTYYA

SEQ ID NO: 1636 - protein, 13 aa, Artificial Sequence
  Description of Artificial Sequence: Synthetic peptide
TLISWSSGRTSYA

SEQ ID NO: 1637 - protein, 12 aa, Artificial Sequence
  Description of Artificial Sequence: Synthetic peptide
ALIRRDGSTIYA

SEQ ID NO: 1638 - protein, 12 aa, Artificial Sequence
  Description of Artificial Sequence: Synthetic peptide
ASITYGGNINYA

SEQ ID NO: 1639 - protein, 13 aa, Artificial Sequence
  Description of Artificial Sequence: Synthetic peptide
ASVNWSGGTTSYA

SEQ ID NO: 1640 - protein, 13 aa, Artificial Sequence
  Description of Artificial Sequence: Synthetic peptide
AAISWSPGRTDYA

SEQ ID NO: 1641 - protein, 12 aa, Artificial Sequence
  Description of Artificial Sequence: Synthetic peptide
ASLATGGNTNYA

SEQ ID NO: 1642 - protein, 12 aa, Artificial Sequence
  Description of Artificial Sequence: Synthetic peptide
AAISRFGSTYYA

SEQ ID NO: 1643 - protein, 12 aa, Artificial Sequence
  Description of Artificial Sequence: Synthetic peptide
AAITSGGSTVYA

SEQ ID NO: 1644 - protein, 12 aa, Artificial Sequence
  Description of Artificial Sequence: Synthetic peptide
AAISTGSVTIYA

SEQ ID NO: 1645 - protein, 12 aa, Artificial Sequence
  Description of Artificial Sequence: Synthetic peptide
AHITAGGLSNYA

SEQ ID NO: 1646 - protein, 12 aa, Artificial Sequence
  Description of Artificial Sequence: Synthetic peptide
ARITSGGSTGYA

SEQ ID NO: 1647 - protein, 13 aa, Artificial Sequence
  Description of Artificial Sequence: Synthetic peptide
AGITWNGDTTYYA

SEQ ID NO: 1648 - protein, 12 aa, Artificial Sequence
  Description of Artificial Sequence: Synthetic peptide
AAVPLSGNTYYA

SEQ ID NO: 1649 - protein, 13 aa, Artificial Sequence
  Description of Artificial Sequence: Synthetic peptide
AAISGSENVTSYA

SEQ ID NO: 1650 - protein, 13 aa, Artificial Sequence
  Description of Artificial Sequence: Synthetic peptide
SSIYSDGSNTYYA

SEQ ID NO: 1651 - protein, 13 aa, Artificial Sequence
  Description of Artificial Sequence: Synthetic peptide
ATISQSGAATAYA

SEQ ID NO: 1652 - protein, 13 aa, Artificial Sequence
  Description of Artificial Sequence: Synthetic peptide
AAINWSGGSTNYA

SEQ ID NO: 1653 - protein, 13 aa, Artificial Sequence
  Description of Artificial Sequence: Synthetic peptide
AVISWTGGSTYYA

SEQ ID NO: 1654 - protein, 12 aa, Artificial Sequence
  Description of Artificial Sequence: Synthetic peptide
AAIGSGGSTSYA

SEQ ID NO: 1655 - protein, 13 aa, Artificial Sequence
  Description of Artificial Sequence: Synthetic peptide
AAINWSHGVTYYA

SEQ ID NO: 1656 - protein, 12 aa, Artificial Sequence
  Description of Artificial Sequence: Synthetic peptide
ASLSIFGATGYA

SEQ ID NO: 1657 - protein, 12 aa, Artificial Sequence
  Description of Artificial Sequence: Synthetic peptide
AAISSGGSTDYA

SEQ ID NO: 1658 - protein, 13 aa, Artificial Sequence
  Description of Artificial Sequence: Synthetic peptide
AAISSSGALTSYA

SEQ ID NO: 1659 - protein, 12 aa, Artificial Sequence
  Description of Artificial Sequence: Synthetic peptide
AHITAGGLSNYA

SEQ ID NO: 1660 - protein, 12 aa, Artificial Sequence
  Description of Artificial Sequence: Synthetic peptide
AGISRSGGTYYA

SEQ ID NO: 1661 - protein, 13 aa, Artificial Sequence
  Description of Artificial Sequence: Synthetic peptide
AAIGWGGGSTRYA

SEQ ID NO: 1662 - protein, 15 aa, Artificial Sequence
  Description of Artificial Sequence: Synthetic peptide
AIITSSDTNDTTNYA

SEQ ID NO: 1663 - protein, 13 aa, Artificial Sequence
  Description of Artificial Sequence: Synthetic peptide
AAIDWSGGSTAYA

SEQ ID NO: 1664 - protein, 12 aa, Artificial Sequence
  Description of Artificial Sequence: Synthetic peptide
AVITREGSTYYA

SEQ ID NO: 1665 - protein, 12 aa, Artificial Sequence
  Description of Artificial Sequence: Synthetic peptide
AAITSGGSTDYA

SEQ ID NO: 1666 - protein, 13 aa, Artificial Sequence
  Description of Artificial Sequence: Synthetic peptide
AAISRSGGNTYYA

SEQ ID NO: 1667 - protein, 12 aa, Artificial Sequence
  Description of Artificial Sequence: Synthetic peptide
AAINSGGSTYYA

SEQ ID NO: 1668 - protein, 12 aa, Artificial Sequence
  Description of Artificial Sequence: Synthetic peptide
AAVTEGGTTSYA

SEQ ID NO: 1669 - protein, 12 aa, Artificial Sequence
  Description of Artificial Sequence: Synthetic peptide
ASVTSGGYTHYA

SEQ ID NO: 1670 - protein, 13 aa, Artificial Sequence
  Description of Artificial Sequence: Synthetic peptide
SWISSSDGSTYYA

SEQ ID NO: 1671 - protein, 12 aa, Artificial Sequence
  Description of Artificial Sequence: Synthetic peptide
AFISGNGGTSYA

SEQ ID NO: 1672 - protein, 13 aa, Artificial Sequence
  Description of Artificial Sequence: Synthetic peptide
AAVTWSGGTTNYA

SEQ ID NO: 1673 - protein, 13 aa, Artificial Sequence
  Description of Artificial Sequence: Synthetic peptide
AAISWGGGSIYYA

SEQ ID NO: 1674 - protein, 13 aa, Artificial Sequence
  Description of Artificial Sequence: Synthetic peptide
AAITWSGAITSYA

SEQ ID NO: 1675 - protein, 13 aa, Artificial Sequence
  Description of Artificial Sequence: Synthetic peptide
AAINSGGSYTYYA

SEQ ID NO: 1676 - protein, 13 aa, Artificial Sequence
  Description of Artificial Sequence: Synthetic peptide
SAINWSGGSLLYA

SEQ ID NO: 1677 - protein, 12 aa, Artificial Sequence
  Description of Artificial Sequence: Synthetic peptide
AVITSNGRPSYA

SEQ ID NO: 1678 - protein, 12 aa, Artificial Sequence
  Description of Artificial Sequence: Synthetic peptide
AIIRGDGRTSYA

SEQ ID NO: 1679 - protein, 13 aa, Artificial Sequence
  Description of Artificial Sequence: Synthetic peptide
AVINWSGGSIYYA

SEQ ID NO: 1680 - protein, 13 aa, Artificial Sequence
  Description of Artificial Sequence: Synthetic peptide
AVVNWNGSSTVYA

SEQ ID NO: 1681 - protein, 11 aa, Artificial Sequence
  Description of Artificial Sequence: Synthetic peptide
AAVRWSSTYYA

SEQ ID NO: 1682 - protein, 13 aa, Artificial Sequence
  Description of Artificial Sequence: Synthetic peptide
ASISSSGVSKHYA

SEQ ID NO: 1683 - protein, 15 aa, Artificial Sequence
  Description of Artificial Sequence: Synthetic peptide
ATIWRRGNTYYANYA

SEQ ID NO: 1684 - protein, 12 aa, Artificial Sequence
  Description of Artificial Sequence: Synthetic peptide
AAISMSGLTSYA

SEQ ID NO: 1685 - protein, 13 aa, Artificial Sequence
  Description of Artificial Sequence: Synthetic peptide
AGIIRSGGETLYA

SEQ ID NO: 1686 - protein, 13 aa, Artificial Sequence
  Description of Artificial Sequence: Synthetic peptide
AVIRWTGGSTYYA

SEQ ID NO: 1687 - protein, 12 aa, Artificial Sequence
  Description of Artificial Sequence: Synthetic peptide
AIITSGGRTNYA

SEQ ID NO: 1688 - protein, 13 aa, Artificial Sequence
  Description of Artificial Sequence: Synthetic peptide
AAITWSGDITNYA

SEQ ID NO: 1689 - protein, 13 aa, Artificial Sequence
  Description of Artificial Sequence: Synthetic peptide
AAINWSSRSTVYA

SEQ ID NO: 1690 - protein, 13 aa, Artificial Sequence
  Description of Artificial Sequence: Synthetic peptide
AGISRSGASTAYA

SEQ ID NO: 1691 - protein, 12 aa, Artificial Sequence
  Description of Artificial Sequence: Synthetic peptide
AHITAGGLSNYA

SEQ ID NO: 1692 - protein, 16 aa, Artificial Sequence
  Description of Artificial Sequence: Synthetic peptide
AAISWTGDSTYYKYYA

SEQ ID NO: 1693 - protein, 12 aa, Artificial Sequence
  Description of Artificial Sequence: Synthetic peptide
SAIDSEGTTTYA

SEQ ID NO: 1694 - protein, 12 aa, Artificial Sequence
  Description of Artificial Sequence: Synthetic peptide
AVRWSDDYTYYA

SEQ ID NO: 1695 - protein, 12 aa, Artificial Sequence
  Description of Artificial Sequence: Synthetic peptide
ASITDGGSTYYA

SEQ ID NO: 1696 - protein, 13 aa, Artificial Sequence
  Description of Artificial Sequence: Synthetic peptide
AAISWDGGATAYA

SEQ ID NO: 1697 - protein, 13 aa, Artificial Sequence
  Description of Artificial Sequence: Synthetic peptide
AATSWSGGSKYYA

SEQ ID NO: 1698 - protein, 12 aa, Artificial Sequence
  Description of Artificial Sequence: Synthetic peptide
AVISSSSSTNYA

SEQ ID NO: 1699 - protein, 13 aa, Artificial Sequence
  Description of Artificial Sequence: Synthetic peptide
AAIRWSGGITYYA

SEQ ID NO: 1700 - protein, 12 aa, Artificial Sequence
  Description of Artificial Sequence: Synthetic peptide
ASIDWSGLTSYA

SEQ ID NO: 1701 - protein, 13 aa, Artificial Sequence
  Description of Artificial Sequence: Synthetic peptide
AGIWRSGGHRDYA

SEQ ID NO: 1702 - protein, 13 aa, Artificial Sequence
  Description of Artificial Sequence: Synthetic peptide
GGISRSGVSTSYA

SEQ ID NO: 1703 - protein, 12 aa, Artificial Sequence
  Description of Artificial Sequence: Synthetic peptide
TIIDNGGPTSYA

SEQ ID NO: 1704 - protein, 12 aa, Artificial Sequence
  Description of Artificial Sequence: Synthetic peptide
CAKEDVGKPFDW

SEQ ID NO: 1705 - protein, 17 aa, Artificial Sequence
  Description of Artificial Sequence: Synthetic peptide
CASWDGLIGLDAYEYDW

SEQ ID NO: 1706 - protein, 12 aa, Artificial Sequence
  Description of Artificial Sequence: Synthetic peptide
CAAFDGYTGSDW

SEQ ID NO: 1707 - protein, 12 aa, Artificial Sequence
  Description of Artificial Sequence: Synthetic peptide
CAADDCYIGCGW

SEQ ID NO: 1708 - protein, 21 aa, Artificial Sequence
  Description of Artificial Sequence: Synthetic peptide
CAAELHSSDYTSPGAESDYGW

SEQ ID NO: 1709 - protein, 21 aa, Artificial Sequence
  Description of Artificial Sequence: Synthetic peptide
CAASASDYGLGLELFHDEYNW

SEQ ID NO: 1710 - protein, 10 aa, Artificial Sequence
  Description of Artificial Sequence: Synthetic peptide
CATVATALIW

SEQ ID NO: 1711 - protein, 18 aa, Artificial Sequence
  Description of Artificial Sequence: Synthetic peptide
CAAELHSSDYTSPGAYAW

SEQ ID NO: 1712 - protein, 10 aa, Artificial Sequence
  Description of Artificial Sequence: Synthetic peptide
CAAIGDGAVW

SEQ ID NO: 1713 - protein, 13 aa, Artificial Sequence
  Description of Artificial Sequence: Synthetic peptide
CALQPFGASNYRW

SEQ ID NO: 1714 - protein, 10 aa, Artificial Sequence
  Description of Artificial Sequence: Synthetic peptide
CAAESWGRQW

SEQ ID NO: 1715 - protein, 11 aa, Artificial Sequence
  Description of Artificial Sequence: Synthetic peptide
CATSGSGSPNW

SEQ ID NO: 1716 - protein, 12 aa, Artificial Sequence
  Description of Artificial Sequence: Synthetic peptide
CAAYLDGYSGSW

SEQ ID NO: 1717 - protein, 12 aa, Artificial Sequence
  Description of Artificial Sequence: Synthetic peptide
CAGFDGYTGSDW

SEQ ID NO: 1718 - protein, 12 aa, Artificial Sequence
  Description of Artificial Sequence: Synthetic peptide
CARGRYGIVERW

SEQ ID NO: 1719 - protein, 13 aa, Artificial Sequence
  Description of Artificial Sequence: Synthetic peptide
CAARRWIPPGPIW

SEQ ID NO: 1720 - protein, 10 aa, Artificial Sequence
  Description of Artificial Sequence: Synthetic peptide
CALDIDYRDW

SEQ ID NO: 1721 - protein, 25 aa, Artificial Sequence
  Description of Artificial Sequence: Synthetic peptide
CAADVYPQDYGLGYVEGKMYYGMDW

SEQ ID NO: 1722 - protein, 11 aa, Artificial Sequence
  Description of Artificial Sequence: Synthetic peptide
CAAYGSGEFDW

SEQ ID NO: 1723 - protein, 10 aa, Artificial Sequence
  Description of Artificial Sequence: Synthetic peptide
CAARRWGYDW

SEQ ID NO: 1724 - protein, 19 aa, Artificial Sequence
  Description of Artificial Sequence: Synthetic peptide
CATFPAIVTDSDYDLGNDW

SEQ ID NO: 1725 - protein, 19 aa, Artificial Sequence
  Description of Artificial Sequence: Synthetic peptide
CASGSDNRARELSRYEYVW

SEQ ID NO: 1726 - protein, 12 aa, Artificial Sequence
  Description of Artificial Sequence: Synthetic peptide
CAAFDGYSGSDW

SEQ ID NO: 1727 - protein, 13 aa, Artificial Sequence
  Description of Artificial Sequence: Synthetic peptide
CALQPFGASSYRW

SEQ ID NO: 1728 - protein, 12 aa, Artificial Sequence
  Description of Artificial Sequence: Synthetic peptide
CAAFDGYSGNHW

SEQ ID NO: 1729 - protein, 19 aa, Artificial Sequence
  Description of Artificial Sequence: Synthetic peptide
CAARTSYNGRYDYIDDYSW

SEQ ID NO: 1730 - protein, 18 aa, Artificial Sequence
  Description of Artificial Sequence: Synthetic peptide
CAAAAGSTWYGTLYEYDW

SEQ ID NO: 1731 - protein, 9 aa, Artificial Sequence
  Description of Artificial Sequence: Synthetic peptide
CAVDGPFGW

SEQ ID NO: 1732 - protein, 11 aa, Artificial Sequence
  Description of Artificial Sequence: Synthetic peptide
CAKDWATGLAW

SEQ ID NO: 1733 - protein, 15 aa, Artificial Sequence
  Description of Artificial Sequence: Synthetic peptide
CAADVSPSYGSRWYW

SEQ ID NO: 1734 - protein, 12 aa, Artificial Sequence
  Description of Artificial Sequence: Synthetic peptide
CAAFDGYTGNYW

SEQ ID NO: 1735 - protein, 11 aa, Artificial Sequence
  Description of Artificial Sequence: Synthetic peptide
CASDESDAANW

SEQ ID NO: 1736 - protein, 8 aa, Artificial Sequence
  Description of Artificial Sequence: Synthetic peptide
CATNDDDV

SEQ ID NO: 1737 - protein, 18 aa, Artificial Sequence
  Description of Artificial Sequence: Synthetic peptide
CAAYRIVVGGTSPGDWRW

SEQ ID NO: 1738 - protein, 12 aa, Artificial Sequence
  Description of Artificial Sequence: Synthetic peptide
CALRRRFGGQEW

SEQ ID NO: 1739 - protein, 12 aa, Artificial Sequence
  Description of Artificial Sequence: Synthetic peptide
CAADNDMGYCSW

SEQ ID NO: 1740 - protein, 18 aa, Artificial Sequence
  Description of Artificial Sequence: Synthetic peptide
CAADGVPEYSDYASGPVW

SEQ ID NO: 1741 - protein, 16 aa, Artificial Sequence
  Description of Artificial Sequence: Synthetic peptide
CAAEVRNGSDYLPIDW

SEQ ID NO: 1742 - protein, 10 aa, Artificial Sequence
  Description of Artificial Sequence: Synthetic peptide
CAVDIDYRDW

SEQ ID NO: 1743 - protein, 12 aa, Artificial Sequence
  Description of Artificial Sequence: Synthetic peptide
CAELDGYFFAHW

SEQ ID NO: 1744 - protein, 11 aa, Artificial Sequence
  Description of Artificial Sequence: Synthetic peptide
CASTDDYGVDW

SEQ ID NO: 1745 - protein, 12 aa, Artificial Sequence
  Description of Artificial Sequence: Synthetic peptide
CAIAHGSSTYNW

SEQ ID NO: 1746 - protein, 13 aa, Artificial Sequence
  Description of Artificial Sequence: Synthetic peptide
CASAYDRGIGYDW

SEQ ID NO: 1747 - protein, 18 aa, Artificial Sequence
  Description of Artificial Sequence: Synthetic peptide
CAADRAADFFAQRDEYDW

SEQ ID NO: 1748 - protein, 12 aa, Artificial Sequence
  Description of Artificial Sequence: Synthetic peptide
CAAFDGGSGTQW

SEQ ID NO: 1749 - protein, 10 aa, Artificial Sequence
  Description of Artificial Sequence: Synthetic peptide
CATVGITLNW

SEQ ID NO: 1750 - protein, 13 aa, Artificial Sequence
  Description of Artificial Sequence: Synthetic peptide
CAARSVYSYEYNW

SEQ ID NO: 1751 - protein, 10 aa, Artificial Sequence
  Description of Artificial Sequence: Synthetic peptide
CALDIDYRHW

SEQ ID NO: 1752 - protein, 16 aa, Artificial Sequence
  Description of Artificial Sequence: Synthetic peptide
CAADRTYSYSSTGYYW

SEQ ID NO: 1753 - protein, 13 aa, Artificial Sequence
  Description of Artificial Sequence: Synthetic peptide
CASAYNPGIGYDW

SEQ ID NO: 1754 - protein, 18 aa, Artificial Sequence
  Description of Artificial Sequence: Synthetic peptide
CAAAAGTTWYGTLYEYDW

SEQ ID NO: 1755 - protein, 17 aa, Artificial Sequence
  Description of Artificial Sequence: Synthetic peptide
CAALIKPSSTDRIFEEW

SEQ ID NO: 1756 - protein, 11 aa, Artificial Sequence
  Description of Artificial Sequence: Synthetic peptide
CAARRWGYHYW

SEQ ID NO: 1757 - protein, 12 aa, Artificial Sequence
  Description of Artificial Sequence: Synthetic peptide
CAAFDGYTGRDW

SEQ ID NO: 1758 - protein, 18 aa, Artificial Sequence
  Description of Artificial Sequence: Synthetic peptide
CATTFGDAGIPDQYDFGW

SEQ ID NO: 1759 - protein, 8 aa, Artificial Sequence
  Description of Artificial Sequence: Synthetic peptide
CADINGDW

SEQ ID NO: 1760 - protein, 6 aa, Artificial Sequence
  Description of Artificial Sequence: Synthetic peptide
CAPFGW

SEQ ID NO: 1761 - protein, 15 aa, Artificial Sequence
  Description of Artificial Sequence: Synthetic peptide
CAADVSPSYGGRWYW

SEQ ID NO: 1762 - protein, 19 aa, Artificial Sequence
  Description of Artificial Sequence: Synthetic peptide
CAADLLGDSDYEPSSGFGW

SEQ ID NO: 1763 - protein, 15 aa, Artificial Sequence
  Description of Artificial Sequence: Synthetic peptide
CAAIAYEEGVYRWDW

SEQ ID NO: 1764 - protein, 10 aa, Artificial Sequence
  Description of Artificial Sequence: Synthetic peptide
CAAHGWGCHW

SEQ ID NO: 1765 - protein, 18 aa, Artificial Sequence
  Description of Artificial Sequence: Synthetic peptide
CAASAIGSGALRRFEYDW

SEQ ID NO: 1766 - protein, 15 aa, Artificial Sequence
  Description of Artificial Sequence: Synthetic peptide
CAAGNGGRYGIVERW

SEQ ID NO: 1767 - protein, 18 aa, Artificial Sequence
  Description of Artificial Sequence: Synthetic peptide
CAARKIYRSLSYYGDYDW

SEQ ID NO: 1768 - protein, 15 aa, Artificial Sequence
  Description of Artificial Sequence: Synthetic peptide
CAALIDYGLGFPIEW

SEQ ID NO: 1769 - protein, 12 aa, Artificial Sequence
  Description of Artificial Sequence: Synthetic peptide
CAAFDGYSGIDW

SEQ ID NO: 1770 - protein, 10 aa, Artificial Sequence
  Description of Artificial Sequence: Synthetic peptide
CAADIFFVNW

SEQ ID NO: 1771 - protein, 20 aa, Artificial Sequence
  Description of Artificial Sequence: Synthetic peptide
CAAEPYIPVRTMRHMTFLTW

SEQ ID NO: 1772 - protein, 11 aa, Artificial Sequence
  Description of Artificial Sequence: Synthetic peptide
CARVDYYMDVW

SEQ ID NO: 1773 - protein, 15 aa, Artificial Sequence
  Description of Artificial Sequence: Synthetic peptide
CARGPDSSGYGFDYW

SEQ ID NO: 1774 - protein, 11 aa, Artificial Sequence
  Description of Artificial Sequence: Synthetic peptide
CARVDRDFDYW

SEQ ID NO: 1775 - protein, 16 aa, Artificial Sequence
  Description of Artificial Sequence: Synthetic peptide
CANLAYYDSSGYYDYW

SEQ ID NO: 1776 - protein, 11 aa, Artificial Sequence
  Description of Artificial Sequence: Synthetic peptide
CTTVDQYFDYW

SEQ ID NO: 1777 - protein, 14 aa, Artificial Sequence
  Description of Artificial Sequence: Synthetic peptide
CAREDYYDSSGYSW

SEQ ID NO: 1778 - protein, 11 aa, Artificial Sequence
  Description of Artificial Sequence: Synthetic peptide
CARADDYFDYW

SEQ ID NO: 1779 - protein, 21 aa, Artificial Sequence
  Description of Artificial Sequence: Synthetic peptide
CAGYSTFGSSSAYYYYSMDVG

SEQ ID NO: 1780 - protein, 10 aa, Artificial Sequence
  Description of Artificial Sequence: Synthetic peptide
CARWGPFDIW

SEQ ID NO: 1781 - protein, 20 aa, Artificial Sequence
  Description of Artificial Sequence: Synthetic peptide
CARDDKYYDSSGYPAYFQHW

SEQ ID NO: 1782 - protein, 8 aa, Artificial Sequence [sequence omitted]

SEQ ID NO: 1783 - protein, 11 aa, Artificial Sequence
  Description of Artificial Sequence: Synthetic peptide
CARVDDYMDVW

SEQ ID NO: 1784 - protein, 18 aa, Artificial Sequence
  Description of Artificial Sequence: Synthetic peptide
CAFLVGPQGVDHGAFDVW

SEQ ID NO: 1785 - protein, 11 aa, Artificial Sequence
  Description of Artificial Sequence: Synthetic peptide
CASDYYYMDVW

SEQ ID NO: 1786 - protein, 13 aa, Artificial Sequence
  Description of Artificial Sequence: Synthetic peptide
CAKEGRAGSLDYW

SEQ ID NO: 1787 - protein, 18 aa, Artificial Sequence
  Description of Artificial Sequence: Synthetic peptide
CATFGATVTATNDAFDIW

SEQ ID NO: 1788 - protein, 19 aa, Artificial Sequence
  Description of Artificial Sequence: Synthetic peptide
CARLATSHQDGTGYLFDYW

SEQ ID NO: 1789 - protein, 20 aa, Artificial Sequence
  Description of Artificial Sequence: Synthetic peptide
CAREGYYYDSSGYLNYFDYW

SEQ ID NO: 1790 - protein, 15 aa, Artificial Sequence
  Description of Artificial Sequence: Synthetic peptide
CAIGYYDSSGYFDYW

SEQ ID NO: 1791 - protein, 19 aa, Artificial Sequence
  Description of Artificial Sequence: Synthetic peptide
CARDRYYDTSASYFESETW

SEQ ID NO: 1792 - protein, 14 aa, Artificial Sequence
  Description of Artificial Sequence: Synthetic peptide
CARSNTGWYSFDYW

SEQ ID NO: 1793 - protein, 13 aa, Artificial Sequence
  Description of Artificial Sequence: Synthetic peptide
CVRVTSDYSMDSW

SEQ ID NO: 1794 - protein, 14 aa, Artificial Sequence
  Description of Artificial Sequence: Synthetic peptide
CVRLSSGYYDFDYW

SEQ ID NO: 1795 - protein, 23 aa, Artificial Sequence
  Description of Artificial Sequence: Synthetic peptide
CARAPFYCTTTKCQDNYYYMDVW

SEQ ID NO: 1796 - protein, 18 aa, Artificial Sequence
  Description of Artificial Sequence: Synthetic peptide
CARGGDYDFWSVDYMDVW

SEQ ID NO: 1797 - protein, 11 aa, Artificial Sequence
  Description of Artificial Sequence: Synthetic peptide
CARVTTSFDYW

SEQ ID NO: 1798 - protein, 11 aa, Artificial Sequence
  Description of Artificial Sequence: Synthetic peptide
CATDYSAFDMW

SEQ ID NO: 1799 - protein, 14 aa, Artificial Sequence
  Description of Artificial Sequence: Synthetic peptide
CARVTSSLSGMDVW

SEQ ID NO: 1800 - protein, 14 aa, Artificial Sequence
  Description of Artificial Sequence: Synthetic peptide
CAREGYYDSSGYYW

SEQ ID NO: 1801 - protein, 11 aa, Artificial Sequence
  Description of Artificial Sequence: Synthetic peptide
CARADGYFDYW

SEQ ID NO: 1802 - protein, 14 aa, Artificial Sequence
  Description of Artificial Sequence: Synthetic peptide
CATFNWNDEGFDFW

SEQ ID NO: 1803 - protein, 19 aa, Artificial Sequence
  Description of Artificial Sequence: Synthetic peptide
CATDFYGWGTRERDAFDIW

SEQ ID NO: 1804 - protein, 15 aa, Artificial Sequence
  Description of Artificial Sequence: Synthetic peptide
CASLIAAQDYYFDYW

SEQ ID NO: 1805 - protein, 14 aa, Artificial Sequence
  Description of Artificial Sequence: Synthetic peptide
CATYCSSTSCFDYW

SEQ ID NO: 1806 - protein, 14 aa, Artificial Sequence
  Description of Artificial Sequence: Synthetic peptide
CARELGYSSTVWPW

SEQ ID NO: 1807 - protein, 18 aa, Artificial Sequence
  Description of Artificial Sequence: Synthetic peptide
CASLLHTGPSGGNYFDYW

SEQ ID NO: 1808 - protein, 14 aa, Artificial Sequence
  Description of Artificial Sequence: Synthetic peptide
CARVSSGDYGMDVW

SEQ ID NO: 1809 - protein, 11 aa, Artificial Sequence
  Description of Artificial Sequence: Synthetic peptide
CAKVDSGYDYW

SEQ ID NO: 1810 - protein, 20 aa, Artificial Sequence
  Description of Artificial Sequence: Synthetic peptide
CHGLGEGDPYGDYEGYFDLW

SEQ ID NO: 1811 - protein, 15 aa, Artificial Sequence
  Description of Artificial Sequence: Synthetic peptide
CAREVLRQQVVLDYW

SEQ ID NO: 1812 - protein, 24 aa, Artificial Sequence
  Description of Artificial Sequence: Synthetic peptide
CAGLHYYYDSSGYNPTEYYGMDVW

SEQ ID NO: 1813 - protein, 15 aa, Artificial Sequence
  Description of Artificial Sequence: Synthetic peptide
CTHVQNSYYYAMDVW

SEQ ID NO: 1814 - protein, 21 aa, Artificial Sequence
  Description of Artificial Sequence: Synthetic peptide
CTTLGAVYFDSSGYHDYFDYW

SEQ ID NO: 1815 - protein, 15 aa, Artificial Sequence
  Description of Artificial Sequence: Synthetic peptide
CFGLLEVYDMTFDYW

SEQ ID NO: 1816 - protein, 16 aa, Artificial Sequence
  Description of Artificial Sequence: Synthetic peptide
CASLGYCSGGSCFDYW

SEQ ID NO: 1817 - protein, 16 aa, Artificial Sequence
  Description of Artificial Sequence: Synthetic peptide
CAALGILFGYDAFDIW

SEQ ID NO: 1818 - protein, 19 aa, Artificial Sequence
  Description of Artificial Sequence: Synthetic peptide
CAKEGYYDSTGYRTYFQQW

SEQ ID NO: 1819 - protein, 12 aa, Artificial Sequence
  Description of Artificial Sequence: Synthetic peptide
CATTGTVTLGYW

SEQ ID NO: 1820 - protein, 16 aa, Artificial Sequence [sequence omitted]

SEQ ID NO: 1821 - protein, 13 aa, Artificial Sequence
  Description of Artificial Sequence: Synthetic peptide
CARVTNYDAFDIW

SEQ ID NO: 1822 - protein, 18 aa, Artificial Sequence
  Description of Artificial Sequence: Synthetic peptide
CARDSGEHFWDSGYIDHW

SEQ ID NO: 1823 - protein, 11 aa, Artificial Sequence
  Description of Artificial Sequence: Synthetic peptide
CARVDSRFDYW

SEQ ID NO: 1824 - protein, 13 aa, Artificial Sequence
  Description of Artificial Sequence: Synthetic peptide
CARVDDFGYFDLW

SEQ ID NO: 1825 - protein, 19 aa, Artificial Sequence
  Description of Artificial Sequence: Synthetic peptide
CGRHWGIYDSSGFSSFDYW

SEQ ID NO: 1826 - protein, 11 aa, Artificial Sequence
  Description of Artificial Sequence: Synthetic peptide
CASVDGYFDYW

SEQ ID NO: 1827 - protein, 14 aa, Artificial Sequence
  Description of Artificial Sequence: Synthetic peptide
CARALGVTYQFDYW

SEQ ID NO: 1828 - protein, 14 aa, Artificial Sequence
  Description of Artificial Sequence: Synthetic peptide
CASFSGGPADFDYW

SEQ ID NO: 1829 - protein, 17 aa, Artificial Sequence
  Description of Artificial Sequence: Synthetic peptide
CLSVTGDTEDYGVFDTW

SEQ ID NO: 1830 - protein, 15 aa, Artificial Sequence
  Description of Artificial Sequence: Synthetic peptide
CAHWSWELGDWFDPW

SEQ ID NO: 1831 - protein, 18 aa, Artificial Sequence
  Description of Artificial Sequence: Synthetic peptide
CAGLLRYSGTYYDAFDVW

SEQ ID NO: 1832 - protein, 12 aa, Artificial Sequence
  Description of Artificial Sequence: Synthetic peptide
CAGLGWNYMDYW

SEQ ID NO: 1833 - protein, 13 aa, Artificial Sequence
  Description of Artificial Sequence: Synthetic peptide
CATHNSLSGFDYW

SEQ ID NO: 1834 - protein, 12 aa, Artificial Sequence
  Description of Artificial Sequence: Synthetic peptide
CWRLGNDYFDYW

SEQ ID NO: 1835 - protein, 12 aa, Artificial Sequence
  Description of Artificial Sequence: Synthetic peptide
CGGGYGYHFDYW

SEQ ID NO: 1836 - protein, 22 aa, Artificial Sequence
  Description of Artificial Sequence: Synthetic peptide
CWMYYYDSSGYYGNYYYGMDVW

SEQ ID NO: 1837 - protein, 22 aa, Artificial Sequence
  Description of Artificial Sequence: Synthetic peptide
CARGNTKYYYDSSGYSSAFDYW

SEQ ID NO: 1838 - protein, 15 aa, Artificial Sequence
  Description of Artificial Sequence: Synthetic peptide
CWIVGPGPLDGMDVW

SEQ ID NO: 1839 - protein, 16 aa, Artificial Sequence
  Description of Artificial Sequence: Synthetic peptide
CVHLASQTGAGYFDLW

SEQ ID NO: 1840 - protein, 13 aa, Artificial Sequence
  Description of Artificial Sequence: Synthetic peptide
CARYDFWSGYPYW

SEQ ID NO: 1841 - protein, 17 aa, Artificial Sequence
  Description of Artificial Sequence: Synthetic peptide
CAREILWFGEFGEPNVW

SEQ ID NO: 1842 - protein, 16 aa, Artificial Sequence
  Description of Artificial Sequence: Synthetic peptide
CARLHYYDSSGYFDYW

SEQ ID NO: 1843 - protein, 15 aa, Artificial Sequence
  Description of Artificial Sequence: Synthetic peptide
CARDSSATRTGPDYW

SEQ ID NO: 1844 - protein, 12 aa, Artificial Sequence
  Description of Artificial Sequence: Synthetic peptide
CARLGGEGFDYW

SEQ ID NO: 1845 - protein, 15 aa, Artificial Sequence
  Description of Artificial Sequence: Synthetic peptide
CARGLLWFGELFGYW

SEQ ID NO: 1846 - protein, 16 aa, Artificial Sequence
  Description of Artificial Sequence: Synthetic peptide
CVRHSGTDGDSSFDYW

SEQ ID NO: 1847 - protein, 11 aa, Artificial Sequence
  Description of Artificial Sequence: Synthetic peptide
CARFFRAHDYW

SEQ ID NO: 1848 - protein, 11 aa, Artificial Sequence
  Description of Artificial Sequence: Synthetic peptide
CARADYDFDYW

SEQ ID NO: 1849 - protein, 17 aa, Artificial Sequence
  Description of Artificial Sequence: Synthetic peptide
CAKFGRKIVGATELDYW

SEQ ID NO: 1850 - protein, 19 aa, Artificial Sequence
  Description of Artificial Sequence: Synthetic peptide
CARSPSFSQIYYYYYMDVW

SEQ ID NO: 1851 - protein, 20 aa, Artificial Sequence
  Description of Artificial Sequence: Synthetic peptide
CAVVAMRMVTTEGPDVLDVW

SEQ ID NO: 1852 - protein, 20 aa, Artificial Sequence
  Description of Artificial Sequence: Synthetic peptide
CAREGYYYDSSGYPYYFDYW

SEQ ID NO: 1853 - protein, 14 aa, Artificial Sequence
  Description of Artificial Sequence: Synthetic peptide
CARLSQGMVALDYW

SEQ ID NO: 1854 - protein, 17 aa, Artificial Sequence
  Description of Artificial Sequence: Synthetic peptide
CAKDGGYGELHYGMEVW

SEQ ID NO: 1855 - protein, 8 aa, Artificial Sequence [sequence omitted]

SEQ ID NO: 1856 - protein, 10 aa, Artificial Sequence
  Description of Artificial Sequence: Synthetic peptide
CALFGDFDYW

SEQ ID NO: 1857 - protein, 14 aa, Artificial Sequence
  Description of Artificial Sequence: Synthetic peptide
CVRLSSGYFDFDYW

SEQ ID NO: 1858 - protein, 13 aa, Artificial Sequence
  Description of Artificial Sequence: Synthetic peptide
CARFAGWDAFDIW

SEQ ID NO: 1859 - protein, 15 aa, Artificial Sequence
  Description of Artificial Sequence: Synthetic peptide
CARLSSDGYNYFDFW

SEQ ID NO: 1860 - protein, 11 aa, Artificial Sequence
  Description of Artificial Sequence: Synthetic peptide
CTTVDQYFNYW

SEQ ID NO: 1861 - protein, 16 aa, Artificial Sequence
  Description of Artificial Sequence: Synthetic peptide
CATGECDGGSCSLAYW

SEQ ID NO: 1862 - protein, 15 aa, Artificial Sequence
  Description of Artificial Sequence: Synthetic peptide
CVRFGSSWARDLDQW

SEQ ID NO: 1863 - protein, 9 aa, Artificial Sequence
  Description of Artificial Sequence: Synthetic peptide
CTETGTAAW

SEQ ID NO: 1864 - protein, 18 aa, Artificial Sequence
  Description of Artificial Sequence: Synthetic peptide
CLKVLGGDYEADNWFDYW

SEQ ID NO: 1865 - protein, 18 aa, Artificial Sequence
  Description of Artificial Sequence: Synthetic peptide
CARSLYYDRSGSYYFDYW

SEQ ID NO: 1866 - protein, 22 aa, Artificial Sequence
  Description of Artificial Sequence: Synthetic peptide
CARDIGYYDSSGYYNDGGFDYW

SEQ ID NO: 1867 - protein, 21 aa, Artificial Sequence
  Description of Artificial Sequence: Synthetic peptide
CAGHATFGGSSSSYYYGMDVW

SEQ ID NO: 1868 - protein, 12 aa, Artificial Sequence
  Description of Artificial Sequence: Synthetic peptide
CLRLSSSGFDHW

SEQ ID NO: 1869 - protein, 20 aa, Artificial Sequence
  Description of Artificial Sequence: Synthetic peptide
CAKSDGLMGELRSASAFDIW

SEQ ID NO: 1870 - protein, 11 aa, Artificial Sequence
  Description of Artificial Sequence: Synthetic peptide
CTHANDYGDYW

SEQ ID NO: 1871 - protein, 15 aa, Artificial Sequence
  Description of Artificial Sequence: Synthetic peptide
CARLLVREDWYFDLW

SEQ ID NO: 1872 - protein, 11 aa, Artificial Sequence
  Description of Artificial Sequence: Synthetic peptide
CAYNNSSGEYW

SEQ ID NO: 1873 - protein, 14 aa, Artificial Sequence
  Description of Artificial Sequence: Synthetic peptide
CAGDYNFWSGFDHW

SEQ ID NO: 1874 - protein, 14 aa, Artificial Sequence
  Description of Artificial Sequence: Synthetic peptide
CAKKLGGYYAFDIW

SEQ ID NO: 1875 - protein, 11 aa, Artificial Sequence [sequence omitted]

SEQ ID NO: 1876 - protein, 12 aa, Artificial Sequence
  Description of Artificial Sequence: Synthetic peptide
CAIEIVVGGIYW

SEQ ID NO: 1877 - protein, 11 aa, Artificial Sequence
  Description of Artificial Sequence: Synthetic peptide
CATDLYYMDVW

SEQ ID NO: 1878 - protein, 14 aa, Artificial Sequence
  Description of Artificial Sequence: Synthetic peptide
CTTFNWNDEGFDYW

SEQ ID NO: 1879 - protein, 20 aa, Artificial Sequence
  Description of Artificial Sequence: Synthetic peptide
CARERYWNPLPYYYYGMDVW

SEQ ID NO: 1880 - protein, 24 aa, Artificial Sequence
  Description of Artificial Sequence: Synthetic peptide
CARGPFYMYCSGTKCYSTNWFDPW

SEQ ID NO: 1881 - protein, 17 aa, Artificial Sequence
  Description of Artificial Sequence: Synthetic peptide
CARGEIDILTGYWYDYW

SEQ ID NO: 1882 - protein, 21 aa, Artificial Sequence
  Description of Artificial Sequence: Synthetic peptide
CTTLLYYYDSSGYSFDAFDIW

SEQ ID NO: 1883 - protein, 21 aa, Artificial Sequence
  Description of Artificial Sequence: Synthetic peptide
CTALLYYFDNSGYNFDPFDIW

SEQ ID NO: 1884 - protein, 117 aa, Artificial Sequence
  Description of Artificial Sequence: Synthetic polypeptide
EVQLVESGGGLVQPGGSLRLSCAASGGTFSSIGMGWFRQAPGKEREFVAAISWDGGATAYADSVKGRFTISADNSKNTAYLQMNSLKPEDTAVYYCAKEDVGKPFDWGQGTLVTVSS

SEQ ID NO: 1885 - protein, 121 aa, Artificial Sequence
  Description of Artificial Sequence: Synthetic polypeptide
EVQLVESGGGLVQPGGSLRLSCAASGLRFDDYAMGWFRQAPGKERELVAIKFSGGTTDYADSVKGRFTISADNSKNTAYLQMNSLKPEDTAVYYCASWDGLIGLDAYEYDWGQGTLVTVSS

SEQ ID NO: 1886 - protein, 117 aa, Artificial Sequence
  Description of Artificial Sequence: Synthetic polypeptide
EVQLVESGGGLVQPGGSLRLSCAASGSIFSIDVMGWFRQAPGKEREFVAGISWSGDSTLYADSVKGRFTISADNSKNTAYLQMNSLKPEDTAVYYCAAFDGYTGSDWGQGTLVTVSS

SEQ ID NO: 1887 - protein, 117 aa, Artificial Sequence
  Description of Artificial Sequence: Synthetic polypeptide
EVQLVESGGGLVQPGGSLRLSCAASGFTLADYAMGWFRQAPGKEREFVAVITCSGGSTDYADSVKGRFTISADNSKNTAYLQMNSLKPEDTAVYYCAADDCYIGCGWGQGTLVTVSS

SEQ ID NO: 1888 - protein, 131 aa, Artificial Sequence
  Description of Artificial Sequence: Synthetic polypeptide
EVQLVESGGGLVQPGGSLRLSCAASGRTFSSIAMGWFRQAPGKERELVAEITEGGISPSGDNIYYADSVKGRFTISADNSKNTAYLQMNSLKPEDTAVYYCAAELHSSDYTSPGAESDYGWGQGTLVTVSS

SEQ ID NO: 1889 - protein, 126 aa, Artificial Sequence
  Description of Artificial Sequence: Synthetic polypeptide
EVQLVESGGGLVQPGGSLRLSCAASGPTFSSYAMMGWFRQAPGKEREWVAAINNFGTTKYADSVKGRFTISADNSKNTAYLQMNSLKPEDTAVYYCAASASDYGLGLELFHDEYNWGQGTLVTVSS

SEQ ID NO: 1890 - protein, 111 aa, Artificial Sequence
  Description of Artificial Sequence: Synthetic polypeptide
EVQLVESGGGLVQPGGSLRLSCAASGSTGYMGWFRQAPGKEREFVAAIHSGGSTNYADSVKGRFTISADNSKNTAYLQMNSLKPEDTAVYYCATVATALIWGQGTLVTVSS

SEQ ID NO: 1891 - protein, 123 aa, Artificial Sequence
  Description of Artificial Sequence: Synthetic polypeptide
EVQLVESGGGLVQPGGSLRLSCAASGRPFSEYTMGWFRQAPGKEREFVSSIHWGGRGTNYADSVKGRFTISADNSKNTAYLQMNSLKPEDTAVYYCAAELHSSDYTSPGAYAWGQGTLVTVSS

SEQ ID NO: 1892 - protein, 115 aa, Artificial Sequence
  Description of Artificial Sequence: Synthetic polypeptide
EVQLVESGGGLVQPGGSLRLSCAASGLTLSTYGMGWFRQAPGKEREFVAHIPRSTYSPYYADSVKGRFTISADNSKNTAYLQMNSLKPEDTAVYYCAAIGDGAVWGQGTLVTVSS

SEQ ID NO: 1893 - protein, 117 aa, Artificial Sequence
  Description of Artificial Sequence: Synthetic polypeptide
EVQLVESGGGLVQPGGSLRLSCAASGFTFNNHNMGWFRQAPGKEREFVAAISSYSHTAYADSVKGRFTISADNSKNTAYLQMNSLKPEDTAVYYCALQPFGASNYRWGQGTLVTVSS

SEQ ID NO: 1894 - protein, 112 aa, Artificial Sequence
  Description of Artificial Sequence: Synthetic polypeptide
EVQLVESGGGLVQPGGSLRLSCAASGGIYRVMGWFRQAPGKERELVASISSGGGINYADSVKGRFTISADNSKNTAYLQMNSLKPEDTAVYYCAAESWGRQWGQGTLVTVSS

SEQ ID NO: 1895 - protein, 115 aa, Artificial Sequence
  Description of Artificial Sequence: Synthetic polypeptide
EVQLVESGGGLVQPGGSLRLSCAASGYTDSNLWMGWFRQAPGKEREFVAINRSTGSTSYADSVKGRFTISADNSKNTAYLQMNSLKPEDTAVYYCATSGSGSPNWGQGTLVTVSS

SEQ ID NO: 1896 - protein, 116 aa, Artificial Sequence
  Description of Artificial Sequence: Synthetic polypeptide
EVQLVESGGGLVQPGGSLRLSCAASGFTFDYYTMGWFRQAPGKEREFVAAIRSSGGLFYADSVKGRFTISADNSKNTAYLQMNSLKPEDTAVYYCAAYLDGYSGSWGQGTLVTVSS

SEQ ID NO: 1897 - protein, 117 aa, Artificial Sequence
  Description of Artificial Sequence: Synthetic polypeptide
EVQLVESGGGLVQPGGSLRLSCAASGGIFSINVMGWFRQAPGKEREWVSAIRWNGGNTAYADSVKGRFTITADNSKNTAYLQMNSLKPEDTAVYYCAGFDGYTGSDWGQGTLVTVSS

SEQ ID NO: 1898 - protein, 116 aa, Artificial Sequence
  Description of Artificial Sequence: Synthetic polypeptide
EVQLVESGGGLVQPGGSLRLSCAASGFTFDGAAMGWFRQAPGKEREFVATIRWTNSTDYADSVKGRFTISADNSKNTAYLQMNSLKPEDTAVYYCARGRYGIVERWGQGTLVTVSS

SEQ ID NO: 1899 - protein, 117 aa, Artificial Sequence
  Description of Artificial Sequence: Synthetic polypeptide
EVQLVESGGGLVQPGGSLRLSCAASGRTHSIYPMGWFRQAPGKERELVAAIHSGGATVYADSVKGRFTISADNSKNTAYLQMNSLKPEDTAVYYCAARRWIPPGPIWGQGTLVTVSS

SEQ ID NO: 1900 - protein, 115 aa, Artificial Sequence
  Description of Artificial Sequence: Synthetic polypeptide
EVQLVESGGGLVQPGGSLRLSCAASGPTFSIYAMGWFRQAPGKEREFVAGIRWSDVYTQYADSVKGRFTISADNSKNTAYLQMNSLKPEDTAVYYCALDIDYRDWGQGTLVTVSS

SEQ ID NO: 1901 - protein, 132 aa, Artificial Sequence
  Description of Artificial Sequence: Synthetic polypeptide
EVQLVESGGGLVQPGGSLRLSCAASGLTFDDNIHVMGWFPQAPGKEREFVAAIHWSGGSTIYADSVKGRFTINADNSKNTAYLQMNSLKPEDTAVYYCAADVYPQDYGLGYVEGKMYYGMDWGQGTLVTVSS

SEQ ID NO: 1902 - protein, 116 aa, Artificial Sequence
  Description of Artificial Sequence: Synthetic polypeptide
EVQLVESGGGLVQPGGSLRLSCAASGLTLDYYAMGWFRQAPGKEREWVASINWSGGSTYYADSVKGRFTISADNSKNTAYLQMNSLKPEDTAVYYCAAYGSGEFDWGQGTLVTVSS

SEQ ID NO: 1903 - protein, 114 aa, Artificial Sequence
  Description of Artificial Sequence: Synthetic polypeptide
EVQLVESGGGLVQPGGSLRLSCAASGRTIVPYTMGWFRQAPGKERELVAAISPSAFTEYADSVKGRFTISADNSKNTAYLQMNSLKPEDTAVYYCAARRWGYDWGQGTLVTVSS

SEQ ID NO: 1904 - protein, 123 aa, Artificial Sequence
  Description of Artificial Sequence: Synthetic polypeptide
EVQLVESGGGLVQPGGSLRLSCAASGGTFTTYHMGWFRQAPGKEREFVAHISTGGATNYADSVKGRFTISADNSKNTAYLQMNSLKPEDTAVYYCATFPAIVTDSDYDLGNDWGQGTLVTVSS

SEQ ID NO: 1905 - protein, 124 aa, Artificial Sequence
  Description of Artificial Sequence: Synthetic polypeptide
EVQLVESGGGLVQPGGSLRLSCAASGFTFNVFAMGWFRQAPGKEREFVAAINWSDSRTDYADSVKGRFTISADNSKNTAYLQMNSLKPEDTAVYYCASGSDNRARELSRYEYVWGQGTLVTVSS

SEQ ID NO: 1906 - protein, 117 aa, Artificial Sequence
  Description of Artificial Sequence: Synthetic polypeptide
EVQLVESGGGLVQPGGSLRLSCAASGSIFSIDVMGWFRQAPGKEREFVAAISWSGESTLYADSVKGRFTISADNSKNTAYLQMNSLKPEDTAVYYCAAFDGYSGSDWGQGTLVTVSS

SEQ ID NO: 1907 - protein, 117 aa, Artificial Sequence
  Description of Artificial Sequence: Synthetic polypeptide
EVQLVESGGGLVQPGGSLRLSCAASGFTFSSYSMGWFRQAPGKEREFVAAISSYSHTAYADSVKGRFTIIADNSKNTAYLQMNSLKPEDTAVYYCALQPFGASSYRWGQGTLVTVSS

SEQ ID NO: 1908 - protein, 117 aa, Artificial Sequence
  Description of Artificial Sequence: Synthetic polypeptide
EVQLVESGGGLVQPGGSLRLSCAASGNTFSINVMGWFRQAPGKEREFVAAIHWSGDSTLYADSGKGRFTIIADNNKNTAYLQMISLKPEDTAVYYCAAFDGYSGNHWGQGTLVTVSS

SEQ ID NO: 1909 - protein, 123 aa, Artificial Sequence
  Description of Artificial Sequence: Synthetic polypeptide
EVQLVESGGGLVQPGGSLRLSCAASGRTISSYIMGWFRQAPGKERELVARIYTGGDTIYADSVKGRFTISADNSKNTAYLQMNSLKPEDTAVYYCAARTSYNGRYDYIDDYSWGQGTLVTVSS

SEQ ID NO: 1910 - protein, 122 aa, Artificial Sequence
  Description of Artificial Sequence: Synthetic polypeptide
EVQLVESGGGLVQPGGSLRLSCAASGRANSINWMGWFRQAPGKEREFVATITPGGNTNYADSVKGRFTISADNSKNTAYLQMNSLKPEDTAVYYCAAAAGSTWYGTLYEYDWGQGTLVTVSS

SEQ ID NO: 1911 - protein, 113 aa, Artificial Sequence
  Description of Artificial Sequence: Synthetic polypeptide
EVQLVESGGGLVQPGGSLRLSCAASGGTFSVFAMGWFRQVPGKERELVAEITAGGSTYYADSVKGRFTISADNSKNTAYLQMNSLKPEDTAVYYCAVDGPFGWGQGTLVTVSS

SEQ ID NO: 1912 - protein, 115 aa, Artificial Sequence
  Description of Artificial Sequence: Synthetic polypeptide
EVQLVESGGGLVQPGGSLRLSCAASGFTFDDYPMGWFRQAPGKEREGVASVLRGGYTWYADSVKGRFTISADNSKNTAYLQMNSLKPEDTAVYYCAKDWATGLAWGQGTLVTVSS

SEQ ID NO: 1913 - protein, 120 aa, Artificial Sequence
  Description of Artificial Sequence: Synthetic polypeptide
EVQLVESGGGLVQPGGSLRLSCAASGFALGYYAMGWFRQAPGKEREFVAGIRWTDAYTEYADSVKGRFTISADNSKNTAYLQMNSLKPEDTAVYYCAADVSPSYGSRWYWGQGTLVTVSS

SEQ ID NO: 1914 - protein, 117 aa, Artificial Sequence
  Description of Artificial Sequence: Synthetic polypeptide
EVQLVESGGGLVQPGGSLRLSCAASGRTLDIHVMGWFRQAPGKEREFVAVINWTGESTLYADSVKGRFTISADNSKNTAYLQMNSLKPEDTAVYYCAAFDGYTGNYWGQGTLVTVSS

SEQ ID NO: 1915 - protein, 118 aa, Artificial Sequence
  Description of Artificial Sequence: Synthetic polypeptide
EVQLVESGGGLVQPGGSLRLSCAASGFTPDNYAMGWFRQAPGKEREFVAALGWSGVTTYHYYADSVKGRFTISADNSKNTAYLQMNSLKPEDTAVYYCASDESDAANWGQGTLVTVSS

SEQ ID NO: 1916 - protein, 114 aa, Artificial Sequence
  Description of Artificial Sequence: Synthetic polypeptide
EVQLVESGGGLVQPGGSLRLSCAASGFTFDDYAMGWFRQAPGKERELVATIMWSGNTTYYADSVRRRFIIRDNNNKNTAHLQMNSLKPEDTAVYYCATNDDDVWGQGTLVTVSS

SEQ ID NO: 1917 - protein, 124 aa, Artificial Sequence
  Description of Artificial Sequence: Synthetic polypeptide
EVQLVESGGGLVQPGGSLRLSCAASGRTFSRYIMGWFRQAPGKEREFVAAISWSGGDNTYYADSVKGRFTISADNSKNTAYLQMNSLKPEDTAVYYCAAYRIVVGGTSPGDWRWGQGTLVTVSS

SEQ ID NO: 1918 - protein, 117 aa, Artificial Sequence
  Description of Artificial Sequence: Synthetic polypeptide
EVQLVESGGGLVQPGGSLRLSCAASGPTFSIYAMGWFRQAPGKERELVAGISWNGGSTNYADSVKGRFTISADNSKNTAYLQMNSLKPEDTAVYYCALRRRFGGQEWGQGTLVTVSS

SEQ ID NO: 1919 - protein, 116 aa, Artificial Sequence
  Description of Artificial Sequence: Synthetic polypeptide
EVQLVESGGGLVQPGGSLRLSCAASGRTFSLNAMGWFRQAPGKERELVAAISCGGGSTYADNGKGRFTIITDNSKNTAYLQMMNLKPEDTAAYYCAADNDMGYCSWGQGTLVTVSS

SEQ ID NO: 1920 - protein, 123 aa, Artificial Sequence
  Description of Artificial Sequence: Synthetic polypeptide
EVQLVESGGGLVQPGGSLRLSCAASGSTFSINAMGWFRQAPGKEREFVGGISRSGATTNYADSVKGRFTISADNSKNTAYLQMNSLKPEDTAVYYCAADGVPEYSDYASGPVWGQGTLVTVSS

SEQ ID NO: 1921 - protein, 120 aa, Artificial Sequence
  Description of Artificial Sequence: Synthetic polypeptide
EVQLVESGGGLVQPGGSLRLSCAASGRTFSMHAMGWFRQAPGKERELVASISSQGRTNYADSVKGRFTISADNSKNTAYLQMNSLKPEDTAVYYCAAEVRNGSDYLPIDWGQGTLVTVSS

SEQ ID NO: 1922 - protein, 115 aa, Artificial Sequence
  Description of Artificial Sequence: Synthetic polypeptide
EVQLVESGGGLVQPGGSLRLSCAASGVTLDLYAMGWFRQAPGKEREFVAGIRWTDAYTEYADSVKGRFTISADNSKNTAYLQMNSLKPEDTAVYYCAVDIDYRDWGQGTLVTVSS

SEQ ID NO: 1923 - protein, 117 aa, Artificial Sequence
  Description of Artificial Sequence: Synthetic polypeptide
EVQLVESGGGLVQPGGSLRLSCAASGLPFTINVMGWFRQAPGKEREFVAAIHWSGLTTFYADSVKGLFTITEDNSKNTAHLMMNLLKPEDTAVYCCAELDGYFFAHWGQGTLVTVSS

SEQ ID NO: 1924 - protein, 123 aa, Artificial Sequence
  Description of Artificial Sequence: Synthetic polypeptide
EVQLVESGGGLVQPGGSLRLSCAASGRAFSNYAMGWFRQAPGKEREFVAWINNRGTTDYADSGSTYYADSVKGRFTISADNSKNTAYLQMNSLKPEDTAVYYCASTDDYGVDWGQGTLVTVSS

SEQ ID NO: 1925 - protein, 120 aa, Artificial Sequence
  Description of Artificial Sequence: Synthetic polypeptide
EVQLVESGGGLVQPGGSLRLSCAASGFTPDDYAMGWFRQAPGKEREFVASIGYSGRSNSYNYYADSVKGRFTISADNSKNTAYLQMNSLKPEDTAVYYCAIAHGSSTYNWGQGTLVTVSS

SEQ ID NO: 1926 - protein, 117 aa, Artificial Sequence
  Description of Artificial Sequence: Synthetic polypeptide
EVQLVESGGGLVQPGGSLRLSCAASGFTLNYYGMGWFPQAPGKEREFVAAITSGGAPHYADSVKGRFTINADNSKNTAYLQMNSLKPEDTAVYYCASAYDRGIGYDWGQGTLVTVSS

SEQ ID NO: 1927 - protein, 122 aa, Artificial Sequence
  Description of Artificial Sequence: Synthetic polypeptide
EVQLVESGGGLVQPGGSLRLSCAASGLPFSTKSMGWFRQAPGKEREFVAAIHWSGLTSYADSVKGRFTISADNSKNTAYLQMNSLKPEDTAVYYCAADRAADFFAQRDEYDWGQGTLVTVSS

SEQ ID NO: 1928 - protein, 117 aa, Artificial Sequence
  Description of Artificial Sequence: Synthetic polypeptide
EVQLVESGGGLVQPGGSLRLSCAASGRTFSINAMGWFPQAPGKERELVAAISWSGESTQYADSVKGRFTISADNSKNTAYLQMNSLKPEDTAVYYCAAFDGGSGTQWGQGTLVTVSS

SEQ ID NO: 1929 - protein, 117 aa, Artificial Sequence
  Description of Artificial Sequence: Synthetic polypeptide
EVQLVESGGGLVQPGGSLRLSCAASGEEFSDHWMGWFRQAPGKEREFVAAIHWSGDSTHRNYADSVKGRFTISADNSKNTAYLQMNSLKPEDTAVYYCATVGITLNWGQGTLVTVSS

SEQ ID NO: 1930 - protein, 118 aa, Artificial Sequence
  Description of Artificial Sequence: Synthetic polypeptide
EVQLVESGGGLVQPGGSLRLSCAASGFTFGSYDMGWFRQAPGKEREFVTAINWSGARTAYADSVKGRFTISADNSKNTAYLQMNSLKPEDTAVYYCAARSVYSYEYNWGQGTLVTVSS

SEQ ID NO: 1931 - protein, 115 aa, Artificial Sequence
  Description of Artificial Sequence: Synthetic polypeptide
EVQLVESGGGLVQPGGSLRLSCAASGLPLDLYAMGWFPPAPGKELEFVAGIRWSDAYTEYADSVKGRFTINADNSKNPANLQMNSLKPEDTAVYYCALDIDYRHWGQGTLVTVSS

SEQ ID NO: 1932 - protein, 121 aa, Artificial Sequence
  Description of Artificial Sequence: Synthetic polypeptide
EVQLVESGGGLVQPGGSLRLSCAASGRTSTVNGMGWFRQAPGKEREFVASISQSGAATAYADSVKGRFTISADNSKNTAYLQMNSLKPEDTAVYYCAADRTYSYSSTGYYWGQGTLVTVSS

SEQ ID NO: 1933 - protein, 117 aa, Artificial Sequence
  Description of Artificial Sequence: Synthetic polypeptide
EVQLVESGGGLVQPGGSLRLSCAASGFSLDYYGMGWFRQAPGKEREFVAAITSGGTPHYADSVKGRFTISADNSKNTAYLQMNSLKPEDTAVYYCASAYNPGIGYDWGQGTLVTVSS

SEQ ID NO: 1934 - protein, 122 aa, Artificial Sequence
  Description of Artificial Sequence: Synthetic polypeptide
EVQLVESGGGLVQPGGSLRLSCAASGRPNSINWMGWFRQAPGKERQFVATITPGGNTNYADSVKGRFTISADNSKNTAYLLMNSLKPEDTAVYYCAAAAGTTWYGTLYEYDWGQGTLVTVSS

SEQ ID NO: 1935 - protein, 122 aa, Artificial Sequence
  Description of Artificial Sequence: Synthetic polypeptide
EVQLVESGGGLVQPGGSLRLSCAASGEKFSDHWMGWFRQAPGKEREFVATITFSGARTAYADSVKGRFTISADNSKNTAYLQMNSLKPEDTAVYYCAALIKPSSTDRIFEEWGQGTLVTVSS

SEQ ID NO: 1936 - protein, 115 aa, Artificial Sequence
  Description of Artificial Sequence: Synthetic polypeptide
EVQLVESGGGLVQPGGSLRLSCAASGLTVVPYAMGWFRQAPGKEREFVAAIRRSAVTNYADSVKGRFTIIADNSKNTAYLLMNSLKPEDTAVYYCAARRWGYHYWGQGTLVTVSS

SEQ ID NO: 1937 - protein, 117 aa, Artificial Sequence
  Description of Artificial Sequence: Synthetic polypeptide
EVQLVESGGGLVQPGGSLRLSCAASGTTFNFNVMGWFRQAPGKERELVAVISWTGESTLYADSVKGRFTISADNSKNTAYLQMNSLKPEDTAVYYCAAFDGYTGRDWGQGTLVTVSS

SEQ ID NO: 1938 - protein, 123 aa, Artificial Sequence
  Description of Artificial Sequence: Synthetic polypeptide
EVQLVESGGGLVQPGGSLRLSCAASGIDVNRNAMGWFRQAPGKEREFVAAITWSGGWRYYADSVKGRFTISADNSKNTAYLQMNSLKPEDTAVYYCATTFGDAGIPDQYDFGWGQGTLVTVSS

SEQ ID NO: 1939 - protein, 111 aa, Artificial Sequence
  Description of Artificial Sequence: Synthetic polypeptide
EVQLVESGGGLVQPGGSLRLSCAASGRTFSSNMGWFRQAPGKEREFVARIFGGDRTLYADSVKGRFTISADNSKNTAYLQMNSLKPEDTAVYYCADINGDWGQGTLVTVSS

SEQ ID NO: 1940 - protein, 111 aa, Artificial Sequence
  Description of Artificial Sequence: Synthetic polypeptide
EVQLVESGGGLVQPGGSLRLSCAASGGTFSMGWIRWVPQAQGKELEFMGCIGWITYYADYAKSRFSLFTDNADNTKNPPNMHMNPQKPEDTAVYYCAPFGWGQGTLVTVSS

SEQ ID NO: 1941 - protein, 120 aa, Artificial Sequence
  Description of Artificial Sequence: Synthetic polypeptide
EVQLVESGGGLVQPGGSLRLSCAASGCTLDYYAMGWFRQAPGKEREFVAGIRWTDAYTEYADSVKGRFTISADNSKNTAYLQMNSLKPEDTAVYYCAADVSPSYGGRWYWGQGTLVTVSS

SEQ ID NO: 1942 - protein, 124 aa, Artificial Sequence
  Description of Artificial Sequence: Synthetic polypeptide
EVQLVESGGGLVQPGGSLRLSCAASGLTFSLYRMCWFRQAPGKEREEVSCISNIDGSTYYADSVKGRFTISADNSKNTAYLQMNSLKPEDTAVYYCAADLLGDSDYEPSSGFGWGQGTLVTVSS

SEQ ID NO: 1943 - protein, 120 aa, Artificial Sequence
  Description of Artificial Sequence: Synthetic polypeptide
EVQLVESGGGLVQPGGSLRLSCAASGRSFSSHRMGWFRQAPGKEREFVAAIMWSGSHRNYADSVKGRFTISADNSKNTAYLQMNSLKPEDTAVYYCAAIAYEEGVYRWDWGQGTLVTVSS

SEQ ID NO: 1944 - protein, 114 aa, Artificial Sequence
  Description of Artificial Sequence: Synthetic polypeptide
EVQLVESGGGLVQPGGSLRLSCAASGRIIVPNTMGWFRQAPGKERERVTGISPSAFTEYADSVKGRFTISADNSKNTAYLQMNSLKPEDTAVYYCAAHGWGCHWGQGTLVTVSS

SEQ ID NO: 1945 - protein, 122 aa, Artificial Sequence
  Description of Artificial Sequence: Synthetic polypeptide
EVQLVESGGGLVQPGGSLRLSCAASGSIFIISMGWFRQAPGKEHEFVTGINWSGGSTTYADSVKGRFTINADNSKNTAYLQMNSLKPEDTAVYYCAASAIGSGALRRFEYDWGQGTLVTVSS

SEQ ID NO: 1946 - protein, 120 aa, Artificial Sequence
  Description of Artificial Sequence: Synthetic polypeptide
EVQLVESGGGLVQPGGSLRLSCAASGFSLDYYDMGWFRQAPGKEREFVAALGWSGGSTDYADSVKGRFTISADNSKNTAYLQMNSLKPEDTAVYYCAAGNGGRYGIVERWGQGTLVTVSS

SEQ ID NO: 1947 - protein, 122 aa, Artificial Sequence
  Description of Artificial Sequence: Synthetic polypeptide
EVQLVESGGGLVQPGGSLRLSCAASGTSISNRVMGWFRQAPGKERELVARIYTGGDTLYADSVKGRFTISADNSKNTAYLQMNSLKPEDTAVYYCAARKIYRSLSYYGDYDWGQGTLVTVSS

SEQ ID NO: 1948 - protein, 119 aa, Artificial Sequence
  Description of Artificial Sequence: Synthetic polypeptide
EVQLVESGGGLVQPGGSLRLSCAASGNIDRLYAMGWFRQAPGKEREGVAAIDSDGSTDYADSVKGRFTISADNSKNTAYLQMNSLKPEDTAVYYCAALIDYGLGFPIEWGQGTLVTVSS

SEQ ID NO: 1949 - protein, 117 aa, Artificial Sequence
  Description of Artificial Sequence: Synthetic polypeptide
EVQLVESGGGLVQPGGSLRLSCAASGNTFTINVMGWFRQAPGKEREFVAAINWNGGTTLYADSVKGRFTISADNSKNTAYLQMNSLKPEDTAVYYCAAFDGYSGIDWGQGTLVTVSS

SEQ ID NO: 1950 - protein, 115 aa, Artificial Sequence
  Description of Artificial Sequence: Synthetic polypeptide
EVQLVESGGGLVQPGGSLRLSCAASGFNVNDYAMGWFRQAPGKEREFVAGITSSVGVTNYADSVKGRFTISADNSKNTAYLQMNSLKPEDTAVYYCAADIFFVNWGRGTLVTVSS

SEQ ID NO: 1951 - protein, 125 aa, Artificial Sequence
  Description of Artificial Sequence: Synthetic polypeptide
EVQLVESGGGLVQPGGSLRLSCAASGFTFDHYTMGWFRQAPGKEREFVAAISGSENVTSYADSVKGRFTISADNSKNTAYLQMNSLKPEDTAVYYCAAEPYIPVRTMRHMTFLTWGQGTLVTVSS

SEQ ID NO: 1952 - protein, 115 aa, Artificial Sequence
  Description of Artificial Sequence: Synthetic polypeptide
EVQLVESGGGLVQPGGSLRLSCAASGRTFGNYNMGWFRQAPGKEREFVATINSLGGTSYADSVKGRFTISADNSKNTAYLQMNSLKPEDTAVYYCARVDYYMDVWGQGTLVTVSS

SEQ ID NO: 1953 - protein, 118 aa, Artificial Sequence
  Description of Artificial Sequence: Synthetic polypeptide
EVQLVESGGGLVQPGGSLRLSCAASGFTMSSSWMGWFRQAPGKEREFVTVISGVGTSYADSVKGRFTISADNSKNTAYLQMNSLKPEDTAVYYCARGPDSSGYGFDYWGQGTLVTVSS

SEQ ID NO: 1954 - protein, 115 aa, Artificial Sequence
  Description of Artificial Sequence: Synthetic polypeptide
EVQLVESGGGLVQPGGSLRLSCAASGFTFSPSWMGWFRQAPGKEREFVATINEYGGRNYADSVKGRFTISADNSKNTAYLQMNSLKPEDTAVYYCARVDRDFDYWGQGTLVTVSS

SEQ ID NO: 1955 - protein, 121 aa, Artificial Sequence
  Description of Artificial Sequence: Synthetic polypeptide
EVQLVESGGGLVQPGGSLRLSCAASGFTRDYYTMGWFRQAPGKEREFVAAISRSGSLTSYADSVKGRFTISADNSKNTAYLQMNSLKPEDTAVYYCANLAYYDSSGYYDYWGQGTLVTVSS

SEQ ID NO: 1956 - protein, 112 aa, Artificial Sequence
  Description of Artificial Sequence: Synthetic polypeptide
EVQLVESGGGLVQPGGSLRLSCAASGRTFTMGWFRQAPGKEREFVASTNSAGSTNYADSVNGRFTISADNSKNTAYLQMNSLKPEDTAVYYCTTVDQYFDYWGQGTLVTVSS

SEQ ID NO: 1957 - protein, 119 aa, Artificial Sequence
  Description of Artificial Sequence: Synthetic polypeptide
EVQLVESGGGLVQPGGSLRLSCAASGTTLDYYAMGWFRQAPGKERELVAAISWSGGSTAYADSVKGRFTISADNSKNTAYLQMNSLKPEDTAVYYCAREDYYDSSGYSWGQGTLVTVSS

SEQ ID NO: 1958 - protein, 115 aa, Artificial Sequence
  Description of Artificial Sequence: Synthetic polypeptide
EVQLVESGGGLVQPGGSLRLSCAASGFTFSSYWMGWFRQAPGKEREFVATINWSGVTAYADSVKGRFTISADNSKNTAYLQMNSLKPEDTAVYYCARADDYFDYWGQGTLVTVSS

SEQ ID NO: 1959 - protein, 126 aa, Artificial Sequence
  Description of Artificial Sequence: Synthetic polypeptide
  MOD_RES (63)..(63): Any amino acid
EVQLVESGGGLVQPGGSLRLSCAASGFTLSGIWMGWFLQAPGKEHEFVAIITTGGRTTYADSXKGRFTSSSDNSKNTAYLQMNLLKPEDTAEYYCAGYSTFGSSSAYYYYSMDVGWGQGTLVTVSS

SEQ ID NO: 1960 - protein, 114 aa, Artificial Sequence
  Description of Artificial Sequence: Synthetic polypeptide
EVQLVESGGGLVQPGGSLRLSCAASGFTFDYYAMGWFRQAPGKEREFVSAIDSEGRTSYADSVKGRFTISADNSKNTAYLQMNSLKPEDTAVYYCARWGPFDIWGQGTLVTVSS

SEQ ID NO: 1961 - protein, 125 aa, Artificial Sequence
  Description of Artificial Sequence: Synthetic polypeptide
EVQLVESGGGLVQPGGSLRLSCAASGSIASIHAMGWFRQAPGKEREFVAAISRSGGFGSYADSVKGRFTISADNSKNTAYLQMNSLKPEDTAVYYCARDDKYYDSSGYPAYFQHWGQGTLVTVSS

SEQ ID NO: 1962 - protein, 113 aa, Artificial Sequence
  Description of Artificial Sequence: Synthetic polypeptide
EVQLVESGGGLVQPGGSLRLSCAASGLAFNAYAMGWFRQAPGKEREEVATIGWSGANTYYADSVKGRFTISADNSKNTAYLQMNSLKPEDTAVYYCASDPPGWGQGTLVTVSS

SEQ ID NO: 1963 - protein, 116 aa, Artificial Sequence
  Description of Artificial Sequence: Synthetic polypeptide
EVQLVESGGGLVQPGGSLRLSCAASGSTYTTYSMGWFRQAPGKEREFVAAISGSENVTSYADSVKGRFTISADNSKNTAYLQMNSLKPEDTAVYYCARVDDYMDVWGQGTLVTVSS

SEQ ID NO: 1964 - protein, 123 aa, Artificial Sequence
  Description of Artificial Sequence: Synthetic polypeptide
EVQLVESGGGLVQPGGSLRLSCAASGLTFNDYAMGWFRQAPGKEREFVAHIPRSTYSPYYADSVKGRFTISADNSKNTAYLQMNSLKPEDTAVYYCAFLVGPQGVDHGAFDVWGQGTLVTVSS

SEQ ID NO: 1965 - protein, 116 aa, Artificial Sequence
  Description of Artificial Sequence: Synthetic polypeptide
EVQLVESGGGLVQPGGSLRLSCAASGITFRFKAMGWFRQAPGKEREFVAAVSWDGRNTYYADSVKGRFTISADNSKNTAYLQMNSLKPEDTAVYYCASDYYYMDVWGQGTLVTVSS

SEQ ID NO: 1966 - protein, 118 aa, Artificial Sequence
  Description of Artificial Sequence: Synthetic polypeptide
EVQLVESGGGLVQPGGSLRLSCAASGSTVLINAMGWFRQAPGKEREFVAAVRWSDDYTYYADSVKGRFTISADNSKNTAYLQMNSLKPEDTAVYYCAKEGRAGSLDYWGQGTLVTVSS

SEQ ID NO: 1967 - protein, 123 aa, Artificial Sequence
  Description of Artificial Sequence: Synthetic polypeptide
EVQLVESGGGLVQPGGSLRLSCAASGFTFDDAAMGWFRQAPGKEREFVAHISWSGGSTYYADSVKGRFTISADNSKNTAYLQMNSLKPEDTAVYYCATFGATVTATNDAFDIWGQGTLVTVSS

SEQ ID NO: 1968 - protein, 123 aa, Artificial Sequence
  Description of Artificial Sequence: Synthetic polypeptide
EVQLVESGGGLVQPGGSLRLSCAASGNTGSTGYMGWFRQAPGKEREMVAGVINDGSTVYADSVKGRFTISADNSKNTAYLQMNSLKPEDTAVYYCARLATSHQDGTGYLFDYWGQGTLVTVSS

SEQ ID NO: 1969 - protein, 125 aa, Artificial Sequence
  Description of Artificial Sequence: Synthetic polypeptide
EVQLVESGGGLVQPGGSLRLSCAASGLTFRNYAMGWFRQAPGKEREFIAGMMWSGGTTTYADSVKGRFTISADNSKNTAYLQMNSLKPEDTAVYYCAREGYYYDSSGYLNYFDYWGQGTLVTVSS

SEQ ID NO: 1970 - protein, 120 aa, Artificial Sequence
  Description of Artificial Sequence: Synthetic polypeptide
EVQLVESGGGLVQPGGSLRLSCAASGSILSIAVMGWFRQAPGKEREFVAAISPSAVTTYYADSVKGRFTISADNSKNTAYLQMNSLKPEDTAVYYCAIGYYDSSGYFDYWGQGTLVTVSS

SEQ ID NO: 1971 - protein, 124 aa, Artificial Sequence
  Description of Artificial Sequence: Synthetic polypeptide
EVQLVESGGGLVQPGGSLRLSCAASGSTLPYHAMGWFRQAPGKEREFVAAITWNGASTSYADSVKGRFTISADNSKNTAYLQMNSLKPEDTAVYYCARDRYYDTSASYFESETWGQGTLVTVSS

SEQ ID NO: 1972 - protein, 122 aa, Artificial Sequence
  Description of Artificial Sequence: Synthetic polypeptide
EVQLVESGGGLVQPGGSLRLSCAASGTLFKINAMGWFRQAPGKEREFVAAITSSGSNIDYTYYADSVKGRFTISADNSKNTAYLQMNSLKPEDTAVYYCARSNTGWYSFDYWGQGTLVTVSS

SEQ ID NO: 1973 - protein, 117 aa, Artificial Sequence
  Description of Artificial Sequence: Synthetic polypeptide
EVQLVESGGGLVQPGGSLRLSCAASGRTFSEVVMGWFRQAPGKEREFVATIHSSGSTSYADSVKGRFTISADNSKNTAYLQMNSLKPEDTAVYYCVRVTSDYSMDSWGQGTLVTVSS

SEQ ID NO: 1974 - protein, 119 aa, Artificial Sequence
  Description of Artificial Sequence: Synthetic polypeptide
EVQLVESGGGLVQPGGSLRLSCAASGSIFSMNTMGWFRQAPGKEREFVALINRSGGGINYADSVKGRFTISADNSKNTAYLQMNSLKPEDTAVYYCVRLSSGYYDFDYWGQGTLVTVSS

SEQ ID NO: 1975 - protein, 128 aa, Artificial Sequence
  Description of Artificial Sequence: Synthetic polypeptide
EVQLVESGGGLVQPGGSLRLSCAASGFTLDYYAMGWFRQAPGKEREFVAAINWSGDNTHYADSVKGRFTISADNSKNTAYLQMNSLKPEDTAVYYCARAPFYCTTTKCQDNYYYMDVWGQGTLVTVSS

SEQ ID NO: 1976 - protein, 122 aa, Artificial Sequence
  Description of Artificial Sequence: Synthetic polypeptide
EVQLVESGGGLVQPGGSLRLSCAASGLTFGTYTMGWFRQAPGKEREFVAAISRFGSTYYADSVKGRFTISADNSKNTAYLQMNSLKPEDTAVYYCARGGDYDFWSVDYMDVWGQGTLVTVSS

SEQ ID NO: 1977 - protein, 115 aa, Artificial Sequence
  Description of Artificial Sequence: Synthetic polypeptide
EVQLVESGGGLVQPGGSLRLSCAASGDTFSTSWMGWFRQAPGKEREFVATINTGGGTNYADSVKGRFTISADNSKNTAYLQMNSLKPEDTAVYYCARVTTSFDYWGQGTLVTVSS

SEQ ID NO: 1978 - protein, 115 aa, Artificial Sequence
  Description of Artificial Sequence: Synthetic polypeptide
EVQLVESGGGLVQPGGSLRLSCAASGITFRFKAMGWFRQAPGKEREFVASISRSGTTYYADSVKGRFTISADNSKNTAYLQMNSLKPEDTAVYYCATDYSAFDMWGQGTLVTVSS

SEQ ID NO: 1979 - protein, 118 aa, Artificial Sequence
  Description of Artificial Sequence: Synthetic polypeptide
EVQLVESGGGLVQPGGSLRLSCAASGDTYGSYWMGWFRQAPGKEREFVATITSDDRTNYADSVKGRFTISADNSKNTAYLQMNSLKPEDTAVYYCARVTSSLSGMDVWGQGTLVTVSS

SEQ ID NO: 1980 - protein, 120 aa, Artificial Sequence
  Description of Artificial Sequence: Synthetic polypeptide
  MOD_RES (47)..(47): Any amino acid
EVQLVESGGGLVQPGGSLRLSCAASGYTLKNYYAMGWFRQAPGKERXLVAAIIWTGESTLDADSVKGRFTISADNSKNTAYLQMNSLKPEDTAVYYCAREGYYDSSGYYWGQGTLVTVSS

SEQ ID NO: 1981 - protein, 115 aa, Artificial Sequence
  Description of Artificial Sequence: Synthetic polypeptide
EVQLVESGGGLVQPGGSLRLSCAASGFAFGDSWMGWFRQAPGKEREFVATINWSGVTAYADSVKGRFTISADNSKNTAYLQMNSLKPEDTAVYYCARADGYFDYWGQGTLVTVSS

SEQ ID NO: 1982 - protein, 119 aa, Artificial Sequence
  Description of Artificial Sequence: Synthetic polypeptide
EVQLVESGGGLVQPGGSLRLSCAASGDTFSANRMGWFRQAPGKEREFVASITWSSANTYYADSVKGRFTISADNSKNTAYLQMNSLKPEDTAVYYCATFNWNDEGFDFWGQGTLVTVSS

SEQ ID NO: 1983 - protein, 124 aa, Artificial Sequence
  Description of Artificial Sequence: Synthetic polypeptide
EVQLVESGGGLVQPGGSLRLSCAASGFTLDYYDMGWFRQAPGKEREFVALISWSGGSTYYADSVKGRFTISADNSKNTAYLQMNSLKPEDTAVYYCATDFYGWGTRERDAFDIWGQGTLVTVSS

SEQ ID NO: 1984 - protein, 119 aa, Artificial Sequence
  Description of Artificial Sequence: Synthetic polypeptide
EVQLVESGGGLVQPGGSLRLSCAASGTFQRINHMGWFRQAPGKEREFVATINTGGQPNYADSVKGRFTISADNSKNTAYLQMNSLKPEDTAVYYCASLIAAQDYYFDYWGQGTLVTVSS

SEQ ID NO: 1985 - protein, 119 aa, Artificial Sequence
  Description of Artificial Sequence: Synthetic polypeptide
EVQLVESGGGLVQPGGSLRLSCAASGSAFRSNAMGWFRQAPGKEREFVAHISWSSKSTYYADSVKGRFTISADNSKNTAYLQMNSLKPEDTAVYYCATYCSSTSCFDYWGQGTLVTVSS

SEQ ID NO: 1986 - protein, 119 aa, Artificial Sequence
  Description of Artificial Sequence: Synthetic polypeptide
EVQLVESGGGLVQPGGSLRLSCAASGFTLAYYAMGWFRQAPGKEREFVAAISMSGDDTIYADSVKGRFTISADNSKNTAYLQMNSLKPEDTAVYYCARELGYSSTVWPWGQGTLVTVSS

SEQ ID NO: 1987 - protein, 123 aa, Artificial Sequence
  Description of Artificial Sequence: Synthetic polypeptide
EVQLVESGGGLVQPGGSLRLSCAASGFDFSVSWMGWFRQAPGKEREFVTAITWSGDSTNYADSVKGRFTISADNSKNTAYLQMNSLKPEDTAVYYCASLLHTGPSGGNYFDYWGQGTLVTVSS

SEQ ID NO: 1988 - protein, 118 aa, Artificial Sequence
  Description of Artificial Sequence: Synthetic polypeptide
EVQLVESGGGLVQPGGSLRLSCAASGHTFSTSWMGWFRQAPGKEREFVATINSLGGTNYADSVKGRFTISADNSKNTAYLQMNSLKPEDTAVYYCARVSSGDYGMDVWGQGTLVTVSS

SEQ ID NO: 1989 - protein, 115 aa, Artificial Sequence
  Description of Artificial Sequence: Synthetic polypeptide
EVQLVESGGGLVQPGGSLRLSCAASGNTFSGGFMGWFRQAPGKEREFVAVISSLSSKSYADSVKGRFTISADNSKNTAYLQMNSLKPEDTAVYYCAKVDSGYDYWGQGTLVTVSS

SEQ ID NO: 1990 - protein, 125 aa, Artificial Sequence
  Description of Artificial Sequence: Synthetic polypeptide
EVQLVESGGGLVQPGGSLRLSCAASGFTFSPSWMGWFRQAPGKEREFVAAISWSGGSTAYADSVKGRFTISADNSKNTAYLQMNSLKPEDTAVYYCHGLGEGDPYGDYEGYFDLWGQGTLVTVSS

SEQ ID NO: 1991 - protein, 120 aa, Artificial Sequence
  Description of Artificial Sequence: Synthetic polypeptide
EVQLVESGGGLVQPGGSLRLSCAASGFTFSDYWMGWFRQAPGKERELVARVWWNGGSAYYADSVKGRFTISADNSKNTAYLQMNSLKPEDTAVYYCAREVLRQQVVLDYWGQGTLVTVSS

SEQ ID NO: 1992 - protein, 128 aa, Artificial Sequence
  Description of Artificial Sequence: Synthetic polypeptide
EVQLVESGGGLVQPGGSLRLSCAASGFTFSTSWMGWFRQAPGKEREFVASINEYGGRNYADSVKGRFTISADNSKNTAYLQMNSLKPEDTAVYYCAGLHYYYDSSGYNPTEYYGMDVWGQGTLVTVSS

SEQ ID NO: 1993 - protein, 119 aa, Artificial Sequence
  Description of Artificial Sequence: Synthetic polypeptide
EVQLVESGGGLVQPGGSLRLSCAASGDTYGSYWMGWFRQAPGKEREFVAVITSGGSTNYADSVKGRFTISADNSKNTAYLQMNSLKPEDTAVYYCTHVQNSYYYAMDVWGQGTLVTVSS

SEQ ID NO: 1994 - protein, 127 aa, Artificial Sequence
  Description of Artificial Sequence: Synthetic polypeptide
EVQLVESGGGLVQPGGSLRLSCAASGRTFSSYAMMGWFRQAPGKEREFVASVNWDASQINYADSVKGRFTISADNSKNTAYLQMNSLKPEDTAVYYCTTLGAVYFDSSGYHDYFDYWGQGTLVTVSS

SEQ ID NO: 1995 - protein, 120 aa, Artificial Sequence
  Description of Artificial Sequence: Synthetic polypeptide
EVQLVESGGGLVQPGGSLRLSCAASGGTFGVYHMGWFRQAPGKEREFIGRITWTDGSTYYADSVKGRFTISADNSKNTAYLQMNSLKPEDTAVYYCFGLLEVYDMTFDYWGQGTLVTVSS

SEQ ID NO: 1996 - protein, 121 aa, Artificial Sequence
  Description of Artificial Sequence: Synthetic polypeptide
EVQLVESGGGLVQPGGSLRLSCAASGNMFSINAMGWFRQAPGKEREFVTLISWSSGRTSYADSVKGRFTISADNSKNTAYLQMNSLKPEDTAVYYCASLGYCSGGSCFDYWGQGTLVTVSS

SEQ ID NO: 1997 - protein, 118 aa, Artificial Sequence
  Description of Artificial Sequence: Synthetic polypeptide
EVQLVESGGGLVQPGGSLRLSCAASGLTFSAMGWFRQAPGKEREFVALIRRDGSTIYADSVKGRFTISADNSKNTAYLQMNSLKPEDTAVYYCAALGILFGYDAFDIWGQGTLVTVSS

SEQ ID NO: 1998 - protein, 123 aa, Artificial Sequence
  Description of Artificial Sequence: Synthetic polypeptide
EVQLVESGGGLVQPGGSLRLSCAASGRTFSMHAMGWFRQAPGKERELVASITYGGNINYADSVKGRFTISADNSKNTAYLQMNSLKPEDTAVYYCAKEGYYDSTGYRTYFQQWGQGTLVTVSS

SEQ ID NO: 1999 - protein, 117 aa, Artificial Sequence
  Description of Artificial Sequence: Synthetic polypeptide
EVQLVESGGGLVQPGGSLRLSCAASGFTVSNYAMGWFRQAPGKEREFVASVNWSGGTTSYADSVKGRFTISADNSKNTAYLQMNSLKPEDTAVYYCATTGTVTLGYWGQGTLVTVSS

SEQ ID NO: 2000 - protein, 121 aa, Artificial Sequence
  Description of Artificial Sequence: Synthetic polypeptide
EVQLVESGGGLVQPGGSLRLSCAASGSTVLINAMGWFRQAPGKEREFVAAISWSPGRTDYADSVKGRFTISADNSKNTAYLQMNSLKPEDTAVYYCARDCSGGSCYSGDYWGQGTLVTVSS

SEQ ID NO: 2001 - protein, 117 aa, Artificial Sequence
  Description of Artificial Sequence: Synthetic polypeptide
EVQLVESGGGLVQPGGSLRLSCAASGFSFDRWAMGWFRQAPGKEREWVASLATGGNTNYADSVKGRFTISADNSKNTAYLQMNSLKPEDTAVYYCARVTNYDAFDIWGQGTLVTVSS

SEQ ID NO: 2002 - protein, 122 aa, Artificial Sequence
  Description of Artificial Sequence: Synthetic polypeptide
EVQLVESGGGLVQPGGSLRLSCAASGYTYSSYVMGWFRQAPGKEREFVAAISRFGSTYYADSVKGRFTISADNSKNTAYLQMNSLKPEDTAVYYCARDSGEHFWDSGYIDHWGQGTLVTVSS

SEQ ID NO: 2003 - protein, 115 aa, Artificial Sequence
  Description of Artificial Sequence: Synthetic polypeptide
EVQLVESGGGLVQPGGSLRLSCAASGDTYGSYWMGWFRQAPGKEREVVAAITSGGSTVYADSVKGRFTISADNSKNTAYLQMNSLKPEDTAVYYCARVDSRFDYWGQGTLVTVSS

SEQ ID NO: 2004 - protein, 117 aa, Artificial Sequence
  Description of Artificial Sequence: Synthetic polypeptide
EVQLVESGGGLVQPGGSLRLSCAASGISINTNVMGWFRQAPGKEREFVAAISTGSVTIYADSVKGRFTISADNSKNTAYLQMNSLKPEDTAVYYCARVDDFGYFDLWGQGTLVTVSS

SEQ ID NO: 2005 - protein, 123 aa, Artificial Sequence
  Description of Artificial Sequence: Synthetic polypeptide
EVQLVESGGGLVQPGGSLRLSCAASGFEFENHWMGWFRQAPGKEREYVAHITAGGLSNYADSVKGRFTISADNSKNTAYLQMNSLKPEDTAVYYCGRHWGIYDSSGFSSFDYWGQGTLVTVSS

SEQ ID NO: 2006 - protein, 115 aa, Artificial Sequence
  Description of Artificial Sequence: Synthetic polypeptide
EVQLVESGGGLVQPGGSLRLSCAASGFTMSSSWMGWFRQAPGKEREFVARITSGGSTGYADSVKGRFTISADNSKNTAYLQMNSLKPEDTAVYYCASVDGYFDYWGQGTLVTVSS

SEQ ID NO: 2007 - protein, 118 aa, Artificial Sequence
  Description of Artificial Sequence: Synthetic polypeptide
EVQLVESGGGLVQPGGSLRLSCAASGNIFRSNMGWFRQAPGKEREFVAGITWNGDTTYYADSVKGRFTISADNSKNTAYLQMNSLKPEDTAVYYCARALGVTYQFDYWGQGTLVTVSS

SEQ ID NO: 2008 - protein, 118 aa, Artificial Sequence
  Description of Artificial Sequence: Synthetic polypeptide
EVQLVESGGGLVQPGGSLRLSCAASGLTFDDHSMGWFRQAPGKEREFVAAVPLSGNTYYADSVKGRFTISADNSKNTAYLQMNSLKPEDTAVYYCASFSGGPADFDYWGQGTLVTVSS

SEQ ID NO: 2009 - protein, 122 aa, Artificial Sequence
  Description of Artificial Sequence: Synthetic polypeptide
EVQLVESGGGLVQPGGSLRLSCAASGRAVSTYAMGWFRQAPGKEREFVAAISGSENVTSYADSVKGRFTISADNSKNTAYLQMNSLKPEDTAVYYCLSVTGDTEDYGVFDTWGQGTLVTVSS

SEQ ID NO: 2010 - protein, 123 aa, Artificial Sequence
  Description of Artificial Sequence: Synthetic polypeptide
EVQLVESGGGLVQPGGSLRLSCAASGISGSVFSRTPMGWFRQAPGKEREWVSSIYSDGSNTYYADSVKGRFTISADNSKNTAYLQMNSLKPEDTAVYYCAHWSWELGDWFDPWGQGTLVTVSS

SEQ ID NO: 2011 - protein, 123 aa, Artificial Sequence
  Description of Artificial Sequence: Synthetic polypeptide
EVQLVESGGGLVQPGGSLRLSCAASGDTYGSYWMGWFRQAPGKEREFVATISQSGAATAYADSVKGRFTISADNSKNTAYLQMNSLKPEDTAVYYCAGLLRYSGTYYDAFDVWGQGTLVTVSS

SEQ ID NO: 2012 - protein, 117 aa, Artificial Sequence
  Description of Artificial Sequence: Synthetic polypeptide
EVQLVESGGGLVQPGGSLRLSCAASGDTYGSYWMGWFRQAPGKEREFVAAINWSGGSTNYADSVKGRFTITADNNKNTAYLQMNSLKPEDTAVYYCAGLGWNYMDYWGQGTLVTVSS

SEQ ID NO: 2013 - protein, 118 aa, Artificial Sequence
  Description of Artificial Sequence: Synthetic polypeptide
EVQLVESGGGLVQPGGSLRLSCAASGSTFSGNWMGWFRQAPGKEREFVAVISWTGGSTYYADSVKGRFTISADNSKNTAYLQMNSLKPEDTAVYYCATHNSLSGFDYWGQGTLVTVSS

SEQ ID NO: 2014 - protein, 113 aa, Artificial Sequence
  Description of Artificial Sequence: Synthetic polypeptide
EVQLVESGGGLVQPGGSLRLSCAASGQTFNMGWFRQAPGKEREFVAAIGSGGSTSYADSVKGRFTISADNSKNTAYLQMNSLKPEDTAVYYCWRLGNDYFDYWGQGTLVTVSS

SEQ ID NO: 2015 - protein, 116 aa, Artificial Sequence
  Description of Artificial Sequence: Synthetic polypeptide
EVQLVESGGGLVQPGGSLRLSCAASGIPSIHAMGWFRQAPGKERELVAAINWSHGVTYYADSVKGRFTISADNSKNTAYLQMNSLKPEDTAVYYCGGGYGYHFDYWGQGTLVTVSS

SEQ ID NO: 2016 - protein, 126 aa, Artificial Sequence
  Description of Artificial Sequence: Synthetic polypeptide
EVQLVESGGGLVQPGGSLRLSCAASGLPFSTLHMGWFRQAPGKEREFVASLSIFGATGYADSVKGRFTISADNSKNTAYLQMNSLKPEDTAVYYCWMYYYDSSGYYGNYYYGMDVWGQGTLVTVSS

SEQ ID NO: 2017 - protein, 126 aa, Artificial Sequence
  Description of Artificial Sequence: Synthetic polypeptide
EVQLVESGGGLVQPGGSLRLSCAASGLTFSLFAMGWFRQAPGKERELVAAISSGGSTDYADSVKGRFTISADNSKNTAYLQMNSLKPEDTAVYYCARGNTKYYYDSSGYSSAFDYWGQGTLVTVSS

SEQ ID NO: 2018 - protein, 119 aa, Artificial Sequence
  Description of Artificial Sequence: Synthetic polypeptide
EVQLVESGGGLVQPGGSLRLSCAASGSFSNYAMGWFRQAPGKEREFVAAISSSGALTSYADSVKGRFTISADNSKNTAYLQMNSLKPEDTAVYYCWIVGPGPLDGMDVWGQGTLVTVSS

SEQ ID NO: 2019 - protein, 120 aa, Artificial Sequence
  Description of Artificial Sequence: Synthetic polypeptide
EVQLVESGGGLVQPGGSLRLSCAASGFTLSDRAMGWFRQAPGKEREYVAHITAGGLSNYADSVKGRFTISADNSKNTAYLQMNSLKPEDTAVYYCVHLASQTGAGYFDLWGQGTLVTVSS

SEQ ID NO: 2020 - protein, 117 aa, Artificial Sequence
  Description of Artificial Sequence: Synthetic polypeptide
EVQLVESGGGLVQPGGSLRLSCAASGGTFSSVGMGWFRQAPGKEREFVAGISRSGGTYYADSVKGRFTISADNSKNTAYLQMNSLKPEDTAVYYCARYDFWSGYPYWGQGTLVTVSS

SEQ ID NO: 2021 - protein, 123 aa, Artificial Sequence
  Description of Artificial Sequence: Synthetic polypeptide
EVQLVESGGGLVQPGGSLRLSCAASGFNLDDYADMGWFRQAPGKEREFVAAIGWGGGSTRYADSVKGRFTISADNSKNTAYLQMNSLKPEDTAVYYCAREILWFGEFGEPNVWGQGTLVTVSS

SEQ ID NO: 2022 - protein, 123 aa, Artificial Sequence
  Description of Artificial Sequence: Synthetic polypeptide
EVQLVESGGGLVQPGGSLRLSCAASGITFSNDAMGWFRQAPGKEREFVAIITSSDTNDTTNYADSVKGRFTISADNSKNTAYLQMNSLKPEDTAVYYCARLHYYDSSGYFDYWGQGTLVTVSS

SEQ ID NO: 2023 - protein, 120 aa, Artificial Sequence
  Description of Artificial Sequence: Synthetic polypeptide
EVQLVESGGGLVQPGGSLRLSCAASGSTLSINAMGWFRQAPGKEREFVAAIDWSGGSTAYADSVKGRFTISADNSKNTAYLQMNSLKPEDTAVYYCARDSSATRTGPDYWGQGTLVTVSS

SEQ ID NO: 2024 - protein, 116 aa, Artificial Sequence
  Description of Artificial Sequence: Synthetic polypeptide
EVQLVESGGGLVQPGGSLRLSCAASGHTFSGYAMGWFRQAPGKEREFVAVITREGSTYYADSVKGRFTISADNSKNTAYLQMNSLKPEDTAVYYCARLGGEGFDYWGQGTLVTVSS

SEQ ID NO: 2025 - protein, 119 aa, Artificial Sequence
  Description of Artificial Sequence: Synthetic polypeptide
EVQLVESGGGLVQPGGSLRLSCAASGFAFGDSWMGWFRQAPGKERELVAAITSGGSTDYADSVKGRFTISADNSKNTAYLQMNSLKPEDTAVYYCARGLLWFGELFGYWGQGTLVTVSS

SEQ ID NO: 2026 - protein, 121 aa, Artificial Sequence
  Description of Artificial Sequence: Synthetic polypeptide
EVQLVESGGGLVQPGGSLRLSCAASGGTFSTYWMGWFRQAPGKEREFVAAISRSGGNTYYADSVKGRFTISADNSKNTAYLQMNSLKPEDTAVYYCVRHSGTDGDSSFDYWGQGTLVTVSS

SEQ ID NO: 2027 - protein, 115 aa, Artificial Sequence
  Description of Artificial Sequence: Synthetic polypeptide
EVQLVESGGGLVQPGGSLRLSCAASGLAFDFDGMGWFRQAPGKEREGVAAINSGGSTYYADSVKGRFTISADNSKNTAYLQMNSLKPEDTAVYYCARFFRAHDYWGQGTLVTVSS

SEQ ID NO: 2028 - protein, 115 aa, Artificial Sequence
  Description of Artificial Sequence: Synthetic polypeptide
EVQLVESGGGLVQPGGSLRLSCAASGFTFDRSWMGWFRQAPGKEREFVAAVTEGGTTSYADSVKGRFTISADNSKNTAYLQMNSLKPEDTAVYYCARADYDFDYWGQGTLVTVSS

SEQ ID NO: 2029 - protein, 119 aa, Artificial Sequence
  Description of Artificial Sequence: Synthetic polypeptide
EVQLVESGGGLVQPGGSLRLSCAASGRTYDAMGWFRQAPGKEREFVASVTSGGYTHYADSVKGRFTISADNSKNTAYLQMNSLKPEDTAVYYCAKFGRKIVGATELDYWGQGTLVTVSS

SEQ ID NO: 2030 - protein, 124 aa, Artificial Sequence
  Description of Artificial Sequence: Synthetic polypeptide
EVQLVESGGGLVQPGGSLRLSCAASGSISSIDYMGWFRQAPGKEREGVSWISSSDGSTYYADSVKGRFTISADNSKNTAYLQMNSLKPEDTAVYYCARSPSFSQIYYYYYMDVWGQGTLVTVSS

SEQ ID NO: 2031 - protein, 124 aa, Artificial Sequence
  Description of Artificial Sequence: Synthetic polypeptide
EVQLVESGGGLVQPGGSLRLSCAASGGTFSFYNMGWFRQAPGKEREFVAFISGNGGTSYADSVKGRFTISADNSKNTAYLQMNSLKPEDTAVYYCAVVAMRMVTTEGPDVLDVWGQGTLVTVSS

SEQ ID NO: 2032 - protein, 125 aa, Artificial Sequence
  Description of Artificial Sequence: Synthetic polypeptide
EVQLVESGGGLVQPGGSLRLSCAASGFIGNYHAMGWFRQAPGKEREFVAAVTWSGGTTNYADSVKGRFTISADNSKNTAYLQMNSLKPEDTAVYYCAREGYYYDSSGYPYYFDYWGQGTLVTVSS

SEQ ID NO: 2033 - protein, 119 aa, Artificial Sequence
  Description of Artificial Sequence: Synthetic polypeptide
EVQLVESGGGLVQPGGSLRLSCAASGSSLDAYGMGWFRQAPGKEREFVAAISWGGGSIYYADSVKGRFTISADNSKNTAYLQMNSLKPEDTAVYYCARLSQGMVALDYWGQGTLVTVSS

SEQ ID NO: 2034 - protein, 122 aa, Artificial Sequence
  Description of Artificial Sequence: Synthetic polypeptide
EVQLVESGGGLVQPGGSLRLSCAASGSIASIHAMGWFRQAPGKEREFVAAITWSGAITSYADSVKGRFTISADNSKNTAYLQMNSLKPEDTAVYYCAKDGGYGELHYGMEVWGQGTLVTVSS

SEQ ID NO: 2035 - protein, 113 aa, Artificial Sequence
  Description of Artificial Sequence: Synthetic polypeptide
EVQLVESGGGLVQPGGSLRLSCAASGFTPDDYAMGWFRQAPGKEREFVAAINSGGSYTYYADSVKGRFTISADNSKNTAYLQMNSLKPEDTAVYYCARDRGPWGQGTLVTVSS

SEQ ID NO: 2036 - protein, 115 aa, Artificial Sequence
  Description of Artificial Sequence: Synthetic polypeptide
EVQLVESGGGLVQPGGSLRLSCAASGGTFSVFAMGWFRQAPGKEREFVSAINWSGGSLLYADSVKGRFTISADNSKNTAYLQMNSLKPEDTAVYYCALFGDFDYWGQGTLVTVSS

SEQ ID NO: 2037 - protein, 118 aa, Artificial Sequence
  Description of Artificial Sequence: Synthetic polypeptide
EVQLVESGGGLVQPGGSLRLSCAASGPISGINRMGWFRQAPGKEREFVAVITSNGRPSYADSVKGRFTISADNSKNTAYLQMNSLKPEDTAVYYCVRLSSGYFDFDYWGQGTLVTVSS

SEQ ID NO: 2038 - protein, 117 aa, Artificial Sequence
  Description of Artificial Sequence: Synthetic polypeptide
EVQLVESGGGLVQPGGSLRLSCAASGTSIMVGAMGWFRQAPGKEREFVAIIRGDGRTSYADSVKGRFTISADNSKNTAYLQMNSLKPEDTAVYYCARFAGWDAFDIWGQGTLVTVSS

SEQ ID NO: 2039 - protein, 120 aa, Artificial Sequence
  Description of Artificial Sequence: Synthetic polypeptide
EVQLVESGGGLVQPGGSLRLSCAASGRTFSTHWMGWFRQAPGKEREFVAVINWSGGSIYYADSVKGRFTISADNSKNTAYLQMNSLKPEDTAVYYCARLSSDGYNYFDFWGQGTLVTVSS

SEQ ID NO: 2040 - protein, 115 aa, Artificial Sequence
  Description of Artificial Sequence: Synthetic polypeptide
EVQLVESGGGLVQPGGSLRLSCAASGTIFASAMGWFRQAPGKEHQFVAVVNWNGSSTVYADNVKGRFTIIADNSKNTAYLQMNSLKPEDTAVYYCTTVDQYFNYWGQGTLVTVSS

SEQ ID NO: 2041 - protein, 119 aa, Artificial Sequence
  Description of Artificial Sequence: Synthetic polypeptide
EVQLVESGGGLVQPGGSLRLSCAASGFPFSIWPMGWFRQAPGKEREFVAAVRWSSTYYADSVKGRFTISADNSKNTAYLQMNSLKPEDTAVYYCATGECDGGSCSLAYWGQGTLVTVSS

SEQ ID NO: 2042 - protein, 120 aa, Artificial Sequence
  Description of Artificial Sequence: Synthetic polypeptide
EVQLVESGGGLVQPGGSLRLSCAASGRTFGNYAMGWFRQAPGKEREFVASISSSGVSKHYADSVKGRFTISADNSKNTAYLQMNSLKPEDTAVYYCVRFGSSWARDLDQWGQGTLVTVSS

SEQ ID NO: 2043 - protein, 117 aa, Artificial Sequence
  Description of Artificial Sequence: Synthetic polypeptide
EVQLVESGGGLVQPGGSLRLSCAASGFLFDSYASMGWFRQAPGKEREFVATIWRRGNTYYANYADSVKGRFTISADNSKNTAYLQMNSLKPEDTAVYYCTETGTAAWGQGTLVTVSS

SEQ ID NO: 2044 - protein, 122 aa, Artificial Sequence
  Description of Artificial Sequence: Synthetic polypeptide
EVQLVESGGGLVQPGGSLRLSCAASGLPFSTKSMGWFRQAPGKEREFVAAISMSGLTSYADSVKGRFTISADNSKNTAYLQMNSLKPEDTAVYYCLKVLGGDYEADNWFDYWGQGTLVTVSS

SEQ ID NO: 2045 - protein, 123 aa, Artificial Sequence
  Description of Artificial Sequence: Synthetic polypeptide
EVQLVESGGGLVQPGGSLRLSCAASGNIFRIETMGWFRQAPGKEREFVAGIIRSGGETLYADSVKGRFTISADNSKNTAYLQMNSLKPEDTAVYYCARSLYYDRSGSYYFDYWGQGTLVTVSS

SEQ ID NO: 2046 - protein, 127 aa, Artificial Sequence
  Description of Artificial Sequence: Synthetic polypeptide
EVQLVESGGGLVQPGGSLRLSCAASGIPSSIRAMGWFRQAPGKEREFVAVIRWTGGSTYYADSVKGRFTISADNSKNTAYLQMNSLKPEDTAVYYCARDIGYYDSSGYYNDGGFDYWGQGTLVTVSS

SEQ ID NO: 2047 - protein, 125 aa, Artificial Sequence
  Description of Artificial Sequence: Synthetic polypeptide
EVQLVESGGGLVQPGGSLRLSCAASGFTLSGNWMGWFRQAPGKEREFVAIITSGGRTNYADSVKGRFTISADNSKNTAYLQMNSLKPEDTAVYYCAGHATFGGSSSSYYYGMDVWGQGTLVTVSS

SEQ ID NO: 2048 - protein, 117 aa, Artificial Sequence
  Description of Artificial Sequence: Synthetic polypeptide
EVQLVESGGGLVQPGGSLRLSCAASGFTFSSLAMGWFRQAPGKEREFVAAITWSGDITNYADSVKGRFTITADNSKNTAYLQMNSLKPEDTAVYYCLRLSSSGFDHWGQGTLVTVSS

SEQ ID NO: 2049 - protein, 124 aa, Artificial Sequence
  Description of Artificial Sequence: Synthetic polypeptide
EVQLVESGGGLVQPGGSLRLSCAASGTFGHYAMGWFRQAPGKEREFVAAINWSSRSTVYADSVKGRFTITADNSKNTAYLQMNSLKPEDTAVYYCAKSDGLMGELRSASAFDIWGQGTLVTVSS

SEQ ID NO: 2050 - protein, 116 aa, Artificial Sequence
  Description of Artificial Sequence: Synthetic polypeptide
EVQLVESGGGLVQPGGSLRLSCAASGIPFRSRTMGWFRQAPGKEREFVAGISRSGASTAYADSVKGRFTISADNSKNTAYLQMNSLKPEDTAVYYCTHANDYGDYWGQGTLVTVSS

SEQ ID NO: 2051 - protein, 119 aa, Artificial Sequence
  Description of Artificial Sequence: Synthetic polypeptide
EVQLVESGGGLVQPGGSLRLSCAASGGTFSTSWMGWFRQAPGKEREYVAHITAGGLSNYADSVKGRFTISADNSKNTAYLQMNSLKPEDTAVYYCARLLVREDWYFDLWGQGTLVTVSS

SEQ ID NO: 2052 - protein, 119 aa, Artificial Sequence
  Description of Artificial Sequence: Synthetic polypeptide
EVQLVESGGGLVQPGGSLRLSCAASGGTFSLFAMGWFRQAPGKEREFVAAISWTGDSTYYKYYADSVKGRFTISADNSKNTAYLQMNSLKPEDTAVYYCAYNNSSGEYWGQGTLVTVSS

SEQ ID NO: 2053 - protein, 118 aa, Artificial Sequence
  Description of Artificial Sequence: Synthetic polypeptide
EVQLVESGGGLVQPGGSLRLSCAASGSSFSAYAMGWFRQAPGKEREFVSAIDSEGTTTYADSVKGRFTISADNSKNTAYLQMNSLKPEDTAVYYCAGDYNFWSGFDHWGQGTLVTVSS

SEQ ID NO: 2054 - protein, 118 aa, Artificial Sequence
  Description of Artificial Sequence: Synthetic polypeptide
EVQLVESGGGLVQPGGSLRLSCAASGRTSSPIAMGWFRQAPGKEREPVAVRWSDDYTYYADSVKGRFTISADNSKNTAYLQMNSLKPEDTAVYYCAKKLGGYYAFDIWGQGTLVTVSS

SEQ ID NO: 2055 - protein, 115 aa, Artificial Sequence
  Description of Artificial Sequence: Synthetic polypeptide
EVQLVESGGGLVQPGGSLRLSCAASGLTFNQYTMGWFRQAPGKEREFVASITDGGSTYYADSVKGRFTISADNSKNTAYLQMNSLKPEDTAVYYCARDSRYMDVWGQGTLVTVSS

SEQ ID NO: 2056 - protein, 115 aa, Artificial Sequence
  Description of Artificial Sequence: Synthetic polypeptide
EVQLVESGGGLVQPGGSLRLSCAASGPTFSSMGWFRQAPGKEREFVAAISWDGGATAYADSVKGRFTISADNSKNTAYLQMNSLKPEDTAVYYCAIEIVVGGIYWGQGTLVTVSS

SEQ ID NO: 2057 - protein, 116 aa, Artificial Sequence
  Description of Artificial Sequence: Synthetic polypeptide
EVQLVESGGGLVQPGGSLRLSCAASGIPSTLRAMGWFRQAPGKEREFVAATSWSGGSKYYADSVKGRFTISADNSKNTAYLQMNSLKPEDTAVYYCATDLYYMDVWGQGTLVTVSS

SEQ ID NO: 2058 - protein, 119 aa, Artificial Sequence
  Description of Artificial Sequence: Synthetic polypeptide
EVQLVESGGGLVQPGGSLRLSCAASGGVGFSVTNMGWFRQAPGKEREFVAVISSSSSTNYADSVKGRFTISADNSKNTAYLQMNSLKPEDTAVYYCTTFNWNDEGFDYWGQGTLVTVSS

SEQ ID NO: 2059 - protein, 125 aa, Artificial Sequence
  Description of Artificial Sequence: Synthetic polypeptide
EVQLVESGGGLVQPGGSLRLSCAASGGTFGSYGMGWFRQAPGKEREFVAAIRWSGGITYYADSVKGRFTISADNSKNTAYLQMNSLKPEDTAVYYCARERYWNPLPYYYYGMDVWGQGTLVTVSS

SEQ ID NO: 2060 - protein, 128 aa, Artificial Sequence
  Description of Artificial Sequence: Synthetic polypeptide
EVQLVESGGGLVQPGGSLRLSCAASGGTFSTYAMGWFRQVPGKEREFVASIDWSGLTSYADSVKGRFTISADNSKNTAYLQMNSLKPEDTAVYYCARGPFYMYCSGTKCYSTNWFDPWGQGTLVTVSS

SEQ ID NO: 2061 - protein, 122 aa, Artificial Sequence
  Description of Artificial Sequence: Synthetic polypeptide
EVQLVESGGGLVQPGGSLRLSCAASGPIYAVNRMGWFRQAPGKEREFVAGIWRSGGHRDYADSVKGRFTISADNSKNTAYLQMNSLKPEDTAVYYCARGEIDILTGYWYDYWGQGTLVTVSS

SEQ ID NO: 2062 - protein, 126 aa, Artificial Sequence
  Description of Artificial Sequence: Synthetic polypeptide
EVQLVESGGGLVQPGGSLRLSCAASGFTFSNYWMGWFRQAPGKEREFVGGISRSGVSTSYADSVKGRFTISADNSKNTAYLQMNSLKPEDTAVYYCTTLLYYYDSSGYSFDAFDIWGQGTLVTVSS

SEQ ID NO: 2063 - protein, 125 aa, Artificial Sequence
  Description of Artificial Sequence: Synthetic polypeptide
EVQLVESGGGLVQPGGSLRLSCAASGGTFSAYHMGWFRQAPGKERELVTIIDNGGPTSYADSVKGRFTISADNSKNTAYLQMNSLKPEDTAVYYCTALLYYFDNSGYNFDPFDIWGQGTLVTGSS

SEQ ID NO: 2064 - protein, 126 aa, Artificial Sequence; identical to SEQ ID NO: 493
  Description of Artificial Sequence: Synthetic polypeptide

SEQ ID NO: 2065 - protein, 122 aa, Artificial Sequence; identical to SEQ ID NO: 494
  Description of Artificial Sequence: Synthetic polypeptide

SEQ ID NO: 2066 - protein, 122 aa, Artificial Sequence; identical to SEQ ID NO: 495
  Description of Artificial Sequence: Synthetic polypeptide

SEQ ID NO: 2067 - protein, 129 aa, Artificial Sequence; identical to SEQ ID NO: 496
  Description of Artificial Sequence: Synthetic polypeptide

SEQ ID NO: 2068 - protein, 122 aa, Artificial Sequence
  Description of Artificial Sequence: Synthetic polypeptide
EVQLLESGGGLVQPGGSLRLSCAASGFTFSDFAMAWVRQAPGKGLEWVSAISGSGDITYYADSVKGRFTISRDNSKNTLYLQMNSLRAEDTAVYYCAREADCLPSPWYLDLWGQGTLVTVSS

SEQ ID NO: 2069 - protein, 122 aa, Artificial Sequence; identical to SEQ ID NO: 495
  Description of Artificial Sequence: Synthetic polypeptide

SEQ ID NO: 2070 - protein, 117 aa, Artificial Sequence; identical to SEQ ID NO: 498
  Description of Artificial Sequence: Synthetic polypeptide

SEQ ID NO: 2071 - protein, 122 aa, Artificial Sequence; identical to SEQ ID NO: 499
  Description of Artificial Sequence: Synthetic polypeptide

SEQ ID NO: 2072 - protein, 117 aa, Artificial Sequence; identical to SEQ ID NO: 500
  Description of Artificial Sequence: Synthetic polypeptide

SEQ ID NO: 2073 - protein, 117 aa, Artificial Sequence; identical to SEQ ID NO: 501
  Description of Artificial Sequence: Synthetic polypeptide

SEQ ID NO: 2074 - protein, 117 aa, Artificial Sequence; identical to SEQ ID NO: 502
  Description of Artificial Sequence: Synthetic polypeptide

SEQ ID NO: 2075 - protein, 117 aa, Artificial Sequence; identical to SEQ ID NO: 503
  Description of Artificial Sequence: Synthetic polypeptide

SEQ ID NO: 2076 - protein, 122 aa, Artificial Sequence; identical to SEQ ID NO: 495
  Description of Artificial Sequence: Synthetic polypeptide

SEQ ID NO: 2077 - protein, 122 aa, Artificial Sequence; identical to SEQ ID NO: 495
  Description of Artificial Sequence: Synthetic polypeptide

SEQ ID NO: 2078 - protein, 116 aa, Artificial Sequence; identical to SEQ ID NO: 506
  Description of Artificial Sequence: Synthetic polypeptide

SEQ ID NO: 2079 - protein, 107 aa, Artificial Sequence; identical to SEQ ID NO: 520
  Description of Artificial Sequence: Synthetic polypeptide

SEQ ID NO: 2080 - protein, 108 aa, Artificial Sequence; identical to SEQ ID NO: 521
  Description of Artificial Sequence: Synthetic polypeptide

SEQ ID NO: 2081 - protein, 108 aa, Artificial Sequence; identical to SEQ ID NO: 522
  Description of Artificial Sequence: Synthetic polypeptide

SEQ ID NO: 2082 - protein, 106 aa, Artificial Sequence; identical to SEQ ID NO: 523
  Description of Artificial Sequence: Synthetic polypeptide

SEQ ID NO: 2083 - protein, 108 aa, Artificial Sequence
  Description of Artificial Sequence: Synthetic polypeptide
DIQMTQSPSSLSASVGDRVTITCRASQNIHTYLNWYQQKPGKAPKLLIYAASTFAKGVPSRFSGSGSGTDFTLTISSLQPEDFATYYCQQSYSAPPYTFGQGTKVEIK

SEQ ID NO: 2084 - protein, 108 aa, Artificial Sequence; identical to SEQ ID NO: 524
  Description of Artificial Sequence: Synthetic polypeptide

SEQ ID NO: 2085 - protein, 107 aa, Artificial Sequence; identical to SEQ ID NO: 526
  Description of Artificial Sequence: Synthetic polypeptide

SEQ ID NO: 2086 - protein, 108 aa, Artificial Sequence; identical to SEQ ID NO: 524
  Description of Artificial Sequence: Synthetic polypeptide

SEQ ID NO: 2087 - protein, 108 aa, Artificial Sequence; identical to SEQ ID NO: 527
  Description of Artificial Sequence: Synthetic polypeptide

SEQ ID NO: 2088 - protein, 108 aa, Artificial Sequence; identical to SEQ ID NO: 528
  Description of Artificial Sequence: Synthetic polypeptide

SEQ ID NO: 2089 - protein, 108 aa, Artificial Sequence; identical to SEQ ID NO: 524
  Description of Artificial Sequence: Synthetic polypeptide

SEQ ID NO: 2090 - protein, 108 aa, Artificial Sequence; identical to SEQ ID NO: 529
  Description of Artificial Sequence: Synthetic polypeptide

SEQ ID NO: 2091 - protein, 108 aa, Artificial Sequence; identical to SEQ ID NO: 524
  Description of Artificial Sequence: Synthetic polypeptide

SEQ ID NO: 2092 - protein, 107 aa, Artificial Sequence; identical to SEQ ID NO: 532
  Description of Artificial Sequence: Synthetic polypeptide

SEQ ID NO: 2093 - protein, 107 aa, Artificial Sequence; identical to SEQ ID NO: 533
  Description of Artificial Sequence: Synthetic polypeptide

SEQ ID NO: 2094 - protein, 121 aa, Artificial Sequence; identical to SEQ ID NO: 507
  Description of Artificial Sequence: Synthetic polypeptide

SEQ ID NO: 2095 - protein, 123 aa, Artificial Sequence; identical to SEQ ID NO: 508
  Description of Artificial Sequence: Synthetic polypeptide

SEQ ID NO: 2096 - protein, 123 aa, Artificial Sequence; identical to SEQ ID NO: 509
  Description of Artificial Sequence: Synthetic polypeptide

SEQ ID NO: 2097 - protein, 121 aa, Artificial Sequence; identical to SEQ ID NO: 510
  Description of Artificial Sequence: Synthetic polypeptide

SEQ ID NO: 2098 - protein, 119 aa, Artificial Sequence; identical to SEQ ID NO: 511
  Description of Artificial Sequence: Synthetic polypeptide

SEQ ID NO: 2099 - protein, 110 aa, Artificial Sequence; identical to SEQ ID NO: 534
  Description of Artificial Sequence: Synthetic polypeptide

SEQ ID NO: 2100 - protein, 110 aa, Artificial Sequence; identical to SEQ ID NO: 535
  Description of Artificial Sequence: Synthetic polypeptide

SEQ ID NO: 2101 - protein, 111 aa, Artificial Sequence; identical to SEQ ID NO: 536
  Description of Artificial Sequence: Synthetic polypeptide

SEQ ID NO: 2102 - protein, 112 aa, Artificial Sequence; identical to SEQ ID NO: 537
  Description of Artificial Sequence: Synthetic polypeptide

SEQ ID NO: 2103 - protein, 112 aa, Artificial Sequence; identical to SEQ ID NO: 538
  Description of Artificial Sequence: Synthetic polypeptide

SEQ ID NO: 2104 - protein, 126 aa, Artificial Sequence; identical to SEQ ID NO: 721
  Description of Artificial Sequence: Synthetic polypeptide

SEQ ID NO: 2105 - protein, 121 aa, Artificial Sequence; identical to SEQ ID NO: 722
  Description of Artificial Sequence: Synthetic polypeptide

SEQ ID NO: 2106 - protein, 123 aa, Artificial Sequence; identical to SEQ ID NO: 723
  Description of Artificial Sequence: Synthetic polypeptide

SEQ ID NO: 2107 - protein, 122 aa, Artificial Sequence; identical to SEQ ID NO: 724
  Description of Artificial Sequence: Synthetic polypeptide

SEQ ID NO: 2108 - protein, 121 aa, Artificial Sequence; identical to SEQ ID NO: 725
  Description of Artificial Sequence: Synthetic polypeptide

SEQ ID NO: 2109 - protein, 122 aa, Artificial Sequence; identical to SEQ ID NO: 726
  Description of Artificial Sequence: Synthetic polypeptide

SEQ ID NO: 2110 - protein, 126 aa, Artificial Sequence; identical to SEQ ID NO: 727
  Description of Artificial Sequence: Synthetic polypeptide

SEQ ID NO: 2111 - protein, 121 aa, Artificial Sequence; identical to SEQ ID NO: 728
  Description of Artificial Sequence: Synthetic polypeptide

SEQ ID NO: 2112 - protein, 121 aa, Artificial Sequence; identical to SEQ ID NO: 729
  Description of Artificial Sequence: Synthetic polypeptide

SEQ ID NO: 2113 - protein, 126 aa, Artificial Sequence; identical to SEQ ID NO: 721
  Description of Artificial Sequence: Synthetic polypeptide

SEQ ID NO: 2114 - protein, 121 aa, Artificial Sequence; identical to SEQ ID NO: 731
  Description of Artificial Sequence: Synthetic polypeptide

SEQ ID NO: 2115 - protein, 123 aa, Artificial Sequence; identical to SEQ ID NO: 732
  Description of Artificial Sequence: Synthetic polypeptide

SEQ ID NO: 2116 - protein, 126 aa, Artificial Sequence; identical to SEQ ID NO: 721
  Description of Artificial Sequence: Synthetic polypeptide

SEQ ID NO: 2117 - protein, 126 aa, Artificial Sequence; identical to SEQ ID NO: 734
  Description of Artificial Sequence: Synthetic polypeptide

SEQ ID NO: 2118 - protein, 121 aa, Artificial Sequence; identical to SEQ ID NO: 735
  Description of Artificial Sequence: Synthetic polypeptide

SEQ ID NO: 2119 - protein, 107 aa, Artificial Sequence
  Description of Artificial Sequence: Synthetic polypeptide
DIQMTQSPSSLSASVGDRVTITCRASQSIRKYLNWYQQKPGKAPKLLIYASSTLQRGVPSRFSGSGSGTDFTLTISSLQPEDFATYYCQQSLSTPFTFGQGTKVEIK

SEQ ID NO: 2120 - protein, 107 aa, Artificial Sequence; identical to SEQ ID NO: 756
  Description of Artificial Sequence: Synthetic polypeptide

SEQ ID NO: 2121 - protein, 103 aa, Artificial Sequence; identical to SEQ ID NO: 753
  Description of Artificial Sequence: Synthetic polypeptide

SEQ ID NO: 2122 - protein, 107 aa, Artificial Sequence; identical to SEQ ID NO: 751
  Description of Artificial Sequence: Synthetic polypeptide

SEQ ID NO: 2123 - protein, 107 aa, Artificial Sequence; identical to SEQ ID NO: 755
  Description of Artificial Sequence: Synthetic polypeptide

SEQ ID NO: 2124 - protein, 107 aa, Artificial Sequence; identical to SEQ ID NO: 757
  Description of Artificial Sequence: Synthetic polypeptide

SEQ ID NO: 2125 - protein, 107 aa, Artificial Sequence; identical to SEQ ID NO: 758
  Description of Artificial Sequence: Synthetic polypeptide

SEQ ID NO: 2126 - protein, 107 aa, Artificial Sequence; identical to SEQ ID NO: 752
  Description of Artificial Sequence: Synthetic polypeptide

SEQ ID NO: 2127 - protein, 107 aa, Artificial Sequence; identical to SEQ ID NO: 754
  Description of Artificial Sequence: Synthetic polypeptide

SEQ ID NO: 2128 - protein, 107 aa, Artificial Sequence; identical to SEQ ID NO: 761
  Description of Artificial Sequence: Synthetic polypeptide

SEQ ID NO: 2129 - protein, 107 aa, Artificial Sequence; identical to SEQ ID NO: 759
  Description of Artificial Sequence: Synthetic polypeptide

SEQ ID NO: 2130 - protein, 107 aa, Artificial Sequence; identical to SEQ ID NO: 760
  Description of Artificial Sequence: Synthetic polypeptide

SEQ ID NO: 2131 - protein, 107 aa, Artificial Sequence; identical to SEQ ID NO: 764
  Description of Artificial Sequence: Synthetic polypeptide

SEQ ID NO: 2132 - protein, 107 aa, Artificial Sequence; identical to SEQ ID NO: 762
  Description of Artificial Sequence: Synthetic polypeptide

SEQ ID NO: 2133 - protein, 107 aa, Artificial Sequence; identical to SEQ ID NO: 754
  Description of Artificial Sequence: Synthetic polypeptide

SEQ ID NO: 2134 - protein, 123 aa, Artificial Sequence; identical to SEQ ID NO: 736
  Description of Artificial Sequence: Synthetic polypeptide

SEQ ID NO: 2135 - protein, 120 aa, Artificial Sequence; identical to SEQ ID NO: 737
  Description of Artificial Sequence: Synthetic polypeptide

SEQ ID NO: 2136 - protein, 117 aa, Artificial Sequence; identical to SEQ ID NO: 738
  Description of Artificial Sequence: Synthetic polypeptide

SEQ ID NO: 2137 - protein, 119 aa, Artificial Sequence; identical to SEQ ID NO: 739
  Description of Artificial Sequence: Synthetic polypeptide

SEQ ID NO: 2138 - protein, 124 aa, Artificial Sequence; identical to SEQ ID NO: 740
  Description of Artificial Sequence: Synthetic polypeptide

SEQ ID NO: 2139 - protein, 118 aa, Artificial Sequence; identical to SEQ ID NO: 741
  Description of Artificial Sequence: Synthetic polypeptide

SEQ ID NO: 2140 - protein, 120 aa, Artificial Sequence; identical to SEQ ID NO: 742
  Description of Artificial Sequence: Synthetic polypeptide

SEQ ID NO: 2141 - protein, 117 aa, Artificial Sequence; identical to SEQ ID NO: 743
  Description of Artificial Sequence: Synthetic polypeptide

SEQ ID NO: 2142 - protein, 123 aa, Artificial Sequence; identical to SEQ ID NO: 744
  Description of Artificial Sequence: Synthetic polypeptide

SEQ ID NO: 2143 - protein, 123 aa, Artificial Sequence; identical to SEQ ID NO: 745
  Description of Artificial Sequence: Synthetic polypeptide

SEQ ID NO: 2144 - protein, 126 aa, Artificial Sequence; identical to SEQ ID NO: 746
  Description of Artificial Sequence: Synthetic polypeptide

SEQ ID NO: 2145 - protein, 121 aa, Artificial Sequence; identical to SEQ ID NO: 747
  Description of Artificial Sequence: Synthetic polypeptide

SEQ ID NO: 2146 - protein, 125 aa, Artificial Sequence; identical to SEQ ID NO: 748
  Description of Artificial Sequence: Synthetic polypeptide

SEQ ID NO: 2147 - protein, 130 aa, Artificial Sequence; identical to SEQ ID NO: 749
  Description of Artificial Sequence: Synthetic polypeptide

SEQ ID NO: 2148 - protein, 107 aa, Artificial Sequence; identical to SEQ ID NO: 765
  Description of Artificial Sequence: Synthetic polypeptide

SEQ ID NO: 2149 - protein, 107 aa, Artificial Sequence; identical to SEQ ID NO: 766
  Description of Artificial Sequence: Synthetic polypeptide

SEQ ID NO: 2150 - protein, 107 aa, Artificial Sequence; identical to SEQ ID NO: 767
  Description of Artificial Sequence: Synthetic polypeptide

SEQ ID NO: 2151 - protein, 107 aa, Artificial Sequence; identical to SEQ ID NO: 768
  Description of Artificial Sequence: Synthetic polypeptide

SEQ ID NO: 2152 - protein, 107 aa, Artificial Sequence; identical to SEQ ID NO: 769
  Description of Artificial Sequence: Synthetic polypeptide

SEQ ID NO: 2153 - protein, 107 aa, Artificial Sequence; identical to SEQ ID NO: 770
  Description of Artificial Sequence: Synthetic polypeptide

SEQ ID NO: 2154 - protein, 107 aa, Artificial Sequence; identical to SEQ ID NO: 771
  Description of Artificial Sequence: Synthetic polypeptide

SEQ ID NO: 2155 - protein, 107 aa, Artificial Sequence; identical to SEQ ID NO: 772
  Description of Artificial Sequence: Synthetic polypeptide

SEQ ID NO: 2156 - protein, 107 aa, Artificial Sequence; identical to SEQ ID NO: 773
  Description of Artificial Sequence: Synthetic polypeptide

SEQ ID NO: 2157 - protein, 107 aa, Artificial Sequence; identical to SEQ ID NO: 774
  Description of Artificial Sequence: Synthetic polypeptide

SEQ ID NO: 2158 - protein, 107 aa, Artificial Sequence; identical to SEQ ID NO: 775
  Description of Artificial Sequence: Synthetic polypeptide

SEQ ID NO: 2159 - protein, 107 aa, Artificial Sequence; identical to SEQ ID NO: 776
  Description of Artificial Sequence: Synthetic polypeptide

SEQ ID NO: 2160 - protein, 107 aa, Artificial Sequence; identical to SEQ ID NO: 777
  Description of Artificial Sequence: Synthetic polypeptide

SEQ ID NO: 2161 - protein, 107 aa, Artificial Sequence; identical to SEQ ID NO: 778
  Description of Artificial Sequence: Synthetic polypeptide

SEQ ID NO: 2162 - protein, 116 aa, Artificial Sequence; identical to SEQ ID NO: 1203
  Description of Artificial Sequence: Synthetic polypeptide

SEQ ID NO: 2163 - protein, 116 aa, Artificial Sequence; identical to SEQ ID NO: 1204
  Description of Artificial Sequence: Synthetic polypeptide

SEQ ID NO: 2164 - protein, 114 aa, Artificial Sequence; identical to SEQ ID NO: 1205
  Description of Artificial Sequence: Synthetic polypeptide

SEQ ID NO: 2165 - protein, 116 aa, Artificial Sequence; identical to SEQ ID NO: 1206
  Description of Artificial Sequence: Synthetic polypeptide

SEQ ID NO: 2166 - protein, 120 aa, Artificial Sequence; identical to SEQ ID NO: 1207
  Description of Artificial Sequence: Synthetic polypeptide

SEQ ID NO: 2167 - protein, 118 aa, Artificial Sequence; identical to SEQ ID NO: 1208
  Description of Artificial Sequence: Synthetic polypeptide

SEQ ID NO: 2168 - protein, 116 aa, Artificial Sequence; identical to SEQ ID NO: 1209
  Description of Artificial Sequence: Synthetic polypeptide

SEQ ID NO: 2169 - protein, 120 aa, Artificial Sequence; identical to SEQ ID NO: 1210
  Description of Artificial Sequence: Synthetic polypeptide

SEQ ID NO: 2170 - protein, 125 aa, Artificial Sequence; identical to SEQ ID NO: 1211
  Description of Artificial Sequence: Synthetic polypeptide

SEQ ID NO: 2171 - protein, 121 aa, Artificial Sequence; identical to SEQ ID NO: 1212
  Description of Artificial Sequence: Synthetic polypeptide

SEQ ID NO: 2172 - protein, 117 aa, Artificial Sequence; identical to SEQ ID NO: 1213
  Description of Artificial Sequence: Synthetic polypeptide

SEQ ID NO: 2173 - protein, 123 aa, Artificial Sequence; identical to SEQ ID NO: 1214
  Description of Artificial Sequence: Synthetic polypeptide

SEQ ID NO: 2174 - protein, 120 aa, Artificial Sequence; identical to SEQ ID NO: 1215
  Description of Artificial Sequence: Synthetic polypeptide

SEQ ID NO: 2175 - protein, 120 aa, Artificial Sequence; identical to SEQ ID NO: 1216
  Description of Artificial Sequence: Synthetic polypeptide

SEQ ID NO: 2176 - protein, 120 aa, Artificial Sequence; identical to SEQ ID NO: 1217
  Description of Artificial Sequence: Synthetic polypeptide

SEQ ID NO: 2177 - protein, 120 aa, Artificial Sequence; identical to SEQ ID NO: 1218
  Description of Artificial Sequence: Synthetic polypeptide

SEQ ID NO: 2178 - protein, 114 aa, Artificial Sequence; identical to SEQ ID NO: 1219
  Description of Artificial Sequence: Synthetic polypeptide

SEQ ID NO: 2179 - protein, 114 aa, Artificial Sequence; identical to SEQ ID NO: 1220
  Description of Artificial Sequence: Synthetic polypeptide

SEQ ID NO: 2180 - protein, 114 aa, Artificial Sequence; identical to SEQ ID NO: 1221
  Description of Artificial Sequence: Synthetic polypeptide

SEQ ID NO: 2181 - protein, 114 aa, Artificial Sequence; identical to SEQ ID NO: 1222
  Description of Artificial Sequence: Synthetic polypeptide

SEQ ID NO: 2182 - protein, 114 aa, Artificial Sequence; identical to SEQ ID NO: 1223
  Description of Artificial Sequence: Synthetic polypeptide

SEQ ID NO: 2183 - protein, 128 aa, Artificial Sequence; identical to SEQ ID NO: 1224
  Description of Artificial Sequence: Synthetic polypeptide

SEQ ID NO: 2184 - protein, 114 aa, Artificial Sequence; identical to SEQ ID NO: 1225
  Description of Artificial Sequence: Synthetic polypeptide

SEQ ID NO: 2185 - protein, 114 aa, Artificial Sequence; identical to SEQ ID NO: 1226
  Description of Artificial Sequence: Synthetic polypeptide

SEQ ID NO: 2186 - protein, 120 aa, Artificial Sequence; identical to SEQ ID NO: 1227
  Description of Artificial Sequence: Synthetic polypeptide

SEQ ID NO: 2187 - protein, 124 aa, Artificial Sequence; identical to SEQ ID NO: 1228
  Description of Artificial Sequence: Synthetic polypeptide

SEQ ID NO: 2188 - protein, 120 aa, Artificial Sequence; identical to SEQ ID NO: 1229
  Description of Artificial Sequence: Synthetic polypeptide

SEQ ID NO: 2189 - protein, 120 aa, Artificial Sequence; identical to SEQ ID NO: 1230
  Description of Artificial Sequence: Synthetic polypeptide

SEQ ID NO: 2190 - protein, 120 aa, Artificial Sequence; identical to SEQ ID NO: 1231
  Description of Artificial Sequence: Synthetic polypeptide

SEQ ID NO: 2191 - protein, 114 aa, Artificial Sequence; identical to SEQ ID NO: 1232
  Description of Artificial Sequence: Synthetic polypeptide

SEQ ID NO: 2192 - protein, 114 aa, Artificial Sequence; identical to SEQ ID NO: 1233
  Description of Artificial Sequence: Synthetic polypeptide

SEQ ID NO: 2193 - protein, 114 aa, Artificial Sequence; identical to SEQ ID NO: 1234
  Description of Artificial Sequence: Synthetic polypeptide

SEQ ID NO: 2194 - protein, 114 aa, Artificial Sequence; identical to SEQ ID NO: 1235
  Description of Artificial Sequence: Synthetic polypeptide

SEQ ID NO: 2195 - protein, 114 aa, Artificial Sequence; identical to SEQ ID NO: 1236
  Description of Artificial Sequence: Synthetic polypeptide

SEQ ID NO: 2196 - protein, 114 aa, Artificial Sequence; identical to SEQ ID NO: 1237
  Description of Artificial Sequence: Synthetic polypeptide

SEQ ID NO: 2197 - protein, 114 aa, Artificial Sequence; identical to SEQ ID NO: 1238
  Description of Artificial Sequence: Synthetic polypeptide

SEQ ID NO: 2198 - protein, 114 aa, Artificial Sequence; identical to SEQ ID NO: 1239
  Description of Artificial Sequence: Synthetic polypeptide

SEQ ID NO: 2199 - protein, 120 aa, Artificial Sequence; identical to SEQ ID NO: 1240
  Description of Artificial Sequence: Synthetic polypeptide

SEQ ID NO: 2200 - protein, 114 aa, Artificial Sequence; identical to SEQ ID NO: 1241
  Description of Artificial Sequence: Synthetic polypeptide

SEQ ID NO: 2201 - protein, 114 aa, Artificial Sequence; identical to SEQ ID NO: 1242
  Description of Artificial Sequence: Synthetic polypeptide

SEQ ID NO: 2202 - protein, 123 aa, Artificial Sequence; identical to SEQ ID NO: 1243
  Description of Artificial Sequence: Synthetic polypeptide

SEQ ID NO: 2203 - protein, 120 aa, Artificial Sequence; identical to SEQ ID NO: 1244
  Description of Artificial Sequence: Synthetic polypeptide

SEQ ID NO: 2204 - protein, 114 aa, Artificial Sequence; identical to SEQ ID NO: 1245
  Description of Artificial Sequence: Synthetic polypeptide

SEQ ID NO: 2205 - protein, 128 aa, Artificial Sequence; identical to SEQ ID NO: 1246
  Description of Artificial Sequence: Synthetic polypeptide

SEQ ID NO: 2206 - protein, 120 aa, Artificial Sequence; identical to SEQ ID NO: 1247
  Description of Artificial Sequence: Synthetic polypeptide

SEQ ID NO: 2207 - protein, 114 aa, Artificial Sequence; identical to SEQ ID NO: 1248
  Description of Artificial Sequence: Synthetic polypeptide

SEQ ID NO: 2208 - protein, 114 aa, Artificial Sequence; identical to SEQ ID NO: 1249
  Description of Artificial Sequence: Synthetic polypeptide

SEQ ID NO: 2209 - protein, 120 aa, Artificial Sequence; identical to SEQ ID NO: 1250
  Description of Artificial Sequence: Synthetic polypeptide

SEQ ID NO: 2210 - protein, 114 aa, Artificial Sequence; identical to SEQ ID NO: 1251
  Description of Artificial Sequence: Synthetic polypeptide

SEQ ID NO: 2211 - protein, 114 aa, Artificial Sequence; identical to SEQ ID NO: 1252
  Description of Artificial Sequence: Synthetic polypeptide

SEQ ID NO: 2212 - protein, 114 aa, Artificial Sequence; identical to SEQ ID NO: 1253
  Description of Artificial Sequence: Synthetic polypeptide

SEQ ID NO: 2213 - protein, 114 aa, Artificial Sequence; identical to SEQ ID NO: 1254
  Description of Artificial Sequence: Synthetic polypeptide

SEQ ID NO: 2214 - protein, 118 aa, Artificial Sequence; identical to SEQ ID NO: 1255
  Description of Artificial Sequence: Synthetic polypeptide

SEQ ID NO: 2215 - protein, 118 aa, Artificial Sequence; identical to SEQ ID NO: 1256
  Description of Artificial Sequence: Synthetic polypeptide

SEQ ID NO: 2216 - protein, 114 aa, Artificial Sequence; identical to SEQ ID NO: 1257
  Description of Artificial Sequence: Synthetic polypeptide

SEQ ID NO: 2217 - protein, 120 aa, Artificial Sequence; identical to SEQ ID NO: 1258
  Description of Artificial Sequence: Synthetic polypeptide

SEQ ID NO: 2218 - protein, 114 aa, Artificial Sequence; identical to SEQ ID NO: 1259
  Description of Artificial Sequence: Synthetic polypeptide

SEQ ID NO: 2219 - protein, 114 aa, Artificial Sequence; identical to SEQ ID NO: 1260
  Description of Artificial Sequence: Synthetic polypeptide

SEQ ID NO: 2220 - protein, 114 aa, Artificial Sequence; identical to SEQ ID NO: 1261
  Description of Artificial Sequence: Synthetic polypeptide

SEQ ID NO: 2221 - protein, 114 aa, Artificial Sequence; identical to SEQ ID NO: 1262
  Description of Artificial Sequence: Synthetic polypeptide

SEQ ID NO: 2222 - protein, 114 aa, Artificial Sequence; identical to SEQ ID NO: 1263
  Description of Artificial Sequence: Synthetic polypeptide

SEQ ID NO: 2223 - protein, 114 aa, Artificial Sequence; identical to SEQ ID NO: 1264
  Description of Artificial Sequence: Synthetic polypeptide

SEQ ID NO: 2224 - protein, 114 aa, Artificial Sequence; identical to SEQ ID NO: 1265
  Description of Artificial Sequence: Synthetic polypeptide

SEQ ID NO: 2225 - protein, 120 aa, Artificial Sequence; identical to SEQ ID NO: 1266
  Description of Artificial Sequence: Synthetic polypeptide

SEQ ID NO: 2226 - protein, 114 aa, Artificial Sequence; identical to SEQ ID NO: 1267
  Description of Artificial Sequence: Synthetic polypeptide

SEQ ID NO: 2227 - protein, 114 aa, Artificial Sequence; identical to SEQ ID NO: 1268
  Description of Artificial Sequence: Synthetic polypeptide

SEQ ID NO: 2228 - protein, 120 aa, Artificial Sequence; identical to SEQ ID NO: 1269
  Description of Artificial Sequence: Synthetic polypeptide

SEQ ID NO: 2229 - protein, 114 aa, Artificial Sequence; identical to SEQ ID NO: 1270
  Description of Artificial Sequence: Synthetic polypeptide

SEQ ID NO: 2230 - protein, 114 aa, Artificial Sequence; identical to SEQ ID NO: 1271
  Description of Artificial Sequence: Synthetic polypeptide

SEQ ID NO: 2231 - protein, 114 aa, Artificial Sequence; identical to SEQ ID NO: 1272
  Description of Artificial Sequence: Synthetic polypeptide

SEQ ID NO: 2232 - protein, 118 aa, Artificial Sequence; identical to SEQ ID NO: 1273
  Description of Artificial Sequence: Synthetic polypeptide

SEQ ID NO: 2233 - protein, 114 aa, Artificial Sequence; identical to SEQ ID NO: 1274
  Description of Artificial Sequence: Synthetic polypeptide

SEQ ID NO: 2234 - protein, 114 aa, Artificial Sequence; identical to SEQ ID NO: 1275
  Description of Artificial Sequence: Synthetic polypeptide

SEQ ID NO: 2235 - protein, 114 aa, Artificial Sequence; identical to SEQ ID NO: 1276
  Description of Artificial Sequence: Synthetic polypeptide

SEQ ID NO: 2236 - protein, 114 aa, Artificial Sequence; identical to SEQ ID NO: 1277
  Description of Artificial Sequence: Synthetic polypeptide

SEQ ID NO: 2237 - protein, 120 aa, Artificial Sequence; identical to SEQ ID NO: 1278
  Description of Artificial Sequence: Synthetic polypeptide

SEQ ID NO: 2238 - protein, 114 aa, Artificial Sequence; identical to SEQ ID NO: 1279
  Description of Artificial Sequence: Synthetic polypeptide

SEQ ID NO: 2239 - protein, 120 aa, Artificial Sequence; identical to SEQ ID NO: 1280
  Description of Artificial Sequence: Synthetic polypeptide

SEQ ID NO: 2240 - protein, 114 aa, Artificial Sequence; identical to SEQ ID NO: 1281
  Description of Artificial Sequence: Synthetic polypeptide

SEQ ID NO: 2241 - protein, 114 aa, Artificial Sequence; identical to SEQ ID NO: 1282
  Description of Artificial Sequence: Synthetic polypeptide

SEQ ID NO: 2242 - protein, 120 aa, Artificial Sequence; identical to SEQ ID NO: 1283
  Description of Artificial Sequence: Synthetic polypeptide

SEQ ID NO: 2243 - protein, 120 aa, Artificial Sequence; identical to SEQ ID NO: 1284
  Description of Artificial Sequence: Synthetic polypeptide

SEQ ID NO: 2244 - protein, 114 aa, Artificial Sequence; identical to SEQ ID NO: 1285
  Description of Artificial Sequence: Synthetic polypeptide

SEQ ID NO: 2245 - protein, 120 aa, Artificial Sequence; identical to SEQ ID NO: 1286
  Description of Artificial Sequence: Synthetic polypeptide

SEQ ID NO: 2246 - protein, 114 aa, Artificial Sequence; identical to SEQ ID NO: 1287
  Description of Artificial Sequence: Synthetic polypeptide

SEQ ID NO: 2247 - protein, 120 aa, Artificial Sequence; identical to SEQ ID NO: 1288
  Description of Artificial Sequence: Synthetic polypeptide

SEQ ID NO: 2248 - protein, 120 aa, Artificial Sequence; identical to SEQ ID NO: 1289
  Description of Artificial Sequence: Synthetic polypeptide

SEQ ID NO: 2249 - protein, 123 aa, Artificial Sequence; identical to SEQ ID NO: 1290
  Description of Artificial Sequence: Synthetic polypeptide

SEQ ID NO: 2250 - protein, 122 aa, Artificial Sequence; identical to SEQ ID NO: 1291
  Description of Artificial Sequence: Synthetic polypeptide

SEQ ID NO: 2251 - protein, 124 aa, Artificial Sequence; identical to SEQ ID NO: 1292
  Description of Artificial Sequence: Synthetic polypeptide

SEQ ID NO: 2252 - protein, 116 aa, Artificial Sequence; identical to SEQ ID NO: 1293
  Description of Artificial Sequence: Synthetic polypeptide

SEQ ID NO: 2253 - protein, 120 aa, Artificial Sequence; identical to SEQ ID NO: 1294
  Description of Artificial Sequence: Synthetic polypeptide

SEQ ID NO: 2254 - protein, 124 aa, Artificial Sequence; identical to SEQ ID NO: 1295
  Description of Artificial Sequence: Synthetic polypeptide

SEQ ID NO: 2255 - protein, 114 aa, Artificial Sequence; identical to SEQ ID NO: 1296
  Description of Artificial Sequence: Synthetic polypeptide

SEQ ID NO: 2256 - protein, 119 aa, Artificial Sequence; identical to SEQ ID NO: 1297
  Description of Artificial Sequence: Synthetic polypeptide

SEQ ID NO: 2257 - protein, 123 aa, Artificial Sequence; identical to SEQ ID NO: 1298
  Description of Artificial Sequence: Synthetic polypeptide

SEQ ID NO: 2258 - protein, 122 aa, Artificial Sequence; identical to SEQ ID NO: 1299
  Description of Artificial Sequence: Synthetic polypeptide

SEQ ID NO: 2259 - protein, 124 aa, Artificial Sequence; identical to SEQ ID NO: 1300
  Description of Artificial Sequence: Synthetic polypeptide

SEQ ID NO: 2260 - protein, 124 aa, Artificial Sequence; identical to SEQ ID NO: 1301
  Description of Artificial Sequence: Synthetic polypeptide

SEQ ID NO: 2261 - protein, 126 aa, Artificial Sequence; identical to SEQ ID NO: 1302
  Description of Artificial Sequence: Synthetic polypeptide

SEQ ID NO: 2262 - protein, 118 aa, Artificial Sequence; identical to SEQ ID NO: 1303
  Description of Artificial Sequence: Synthetic polypeptide

SEQ ID NO: 2263 - protein, 124 aa, Artificial Sequence; identical to SEQ ID NO: 1304
  Description of Artificial Sequence: Synthetic polypeptide

SEQ ID NO: 2264 - protein, 126 aa, Artificial Sequence; identical to SEQ ID NO: 1305
  Description of Artificial Sequence: Synthetic polypeptide

SEQ ID NO: 2265 - protein, 127 aa, Artificial Sequence; identical to SEQ ID NO: 1306
  Description of Artificial Sequence: Synthetic polypeptide

SEQ ID NO: 2266 - protein, 120 aa, Artificial Sequence; identical to SEQ ID NO: 1307
  Description of Artificial Sequence: Synthetic polypeptide

SEQ ID NO: 2267 - protein, 120 aa, Artificial Sequence; identical to SEQ ID NO: 1308
  Description of Artificial Sequence: Synthetic polypeptide

SEQ ID NO: 2268 - protein, 123 aa, Artificial Sequence; identical to SEQ ID NO: 1309
  Description of Artificial Sequence: Synthetic polypeptide

SEQ ID NO: 2269 - protein, 116 aa, Artificial Sequence; identical to SEQ ID NO: 1310
  Description of Artificial Sequence: Synthetic polypeptide

SEQ ID NO: 2270 - protein, 115 aa, Artificial Sequence; identical to SEQ ID NO: 1311
  Description of Artificial Sequence: Synthetic polypeptide

SEQ ID NO: 2271 - protein, 125 aa, Artificial Sequence; identical to SEQ ID NO: 1312
  Description of Artificial Sequence: Synthetic polypeptide

SEQ ID NO: 2272 - protein, 119 aa, Artificial Sequence; identical to SEQ ID NO: 1313
  Description of Artificial Sequence: Synthetic polypeptide

SEQ ID NO: 2273 - protein, 119 aa, Artificial Sequence; identical to SEQ ID NO: 1314
  Description of Artificial Sequence: Synthetic polypeptide

SEQ ID NO: 2274 - protein, 120 aa, Artificial Sequence; identical to SEQ ID NO: 1315
  Description of Artificial Sequence: Synthetic polypeptide

SEQ ID NO: 2275 - protein, 119 aa, Artificial Sequence; identical to SEQ ID NO: 1316
  Description of Artificial Sequence: Synthetic polypeptide

SEQ ID NO: 2276 - protein, 123 aa, Artificial Sequence; identical to SEQ ID NO: 1317
  Description of Artificial Sequence: Synthetic polypeptide

SEQ ID NO: 2277 - protein, 122 aa, Artificial Sequence; identical to SEQ ID NO: 1318
  Description of Artificial Sequence: Synthetic polypeptide

SEQ ID NO: 2278 - protein, 118 aa, Artificial Sequence; identical to SEQ ID NO: 1319
  Description of Artificial Sequence: Synthetic polypeptide

SEQ ID NO: 2279 - protein, 120 aa, Artificial Sequence; identical to SEQ ID NO: 1320
  Description of Artificial Sequence: Synthetic polypeptide

SEQ ID NO: 2280 - protein, 122 aa, Artificial Sequence; identical to SEQ ID NO: 1321
  Description of Artificial Sequence: Synthetic polypeptide

SEQ ID NO: 2281 - protein, 119 aa, Artificial Sequence; identical to SEQ ID NO: 1322
  Description of Artificial Sequence: Synthetic polypeptide

SEQ ID NO: 2282 - protein, 123 aa, Artificial Sequence; identical to SEQ ID NO: 1323
  Description of Artificial Sequence: Synthetic polypeptide

SEQ ID NO: 2283 - protein, 118 aa, Artificial Sequence; identical to SEQ ID NO: 1324
  Description of Artificial Sequence: Synthetic polypeptide

SEQ ID NO: 2284 - protein, 118 aa, Artificial Sequence; identical to SEQ ID NO: 1326
  Description of Artificial Sequence: Synthetic polypeptide

SEQ ID NO: 2285 - protein, 118 aa, Artificial Sequence; identical to SEQ ID NO: 1327
  Description of Artificial Sequence: Synthetic polypeptide

SEQ ID NO: 2286 - protein, 123 aa, Artificial Sequence; identical to SEQ ID NO: 1328
  Description of Artificial Sequence: Synthetic polypeptide

SEQ ID NO: 2287 - protein, 123 aa, Artificial Sequence; identical to SEQ ID NO: 1329
  Description of Artificial Sequence: Synthetic polypeptide

SEQ ID NO: 2288 - protein, 119 aa, Artificial Sequence; identical to SEQ ID NO: 1330
  Description of Artificial Sequence: Synthetic polypeptide

SEQ ID NO: 2289 - protein, 121 aa, Artificial Sequence; identical to SEQ ID NO: 1331
  Description of Artificial Sequence: Synthetic polypeptide

SEQ ID NO: 2290 - protein, 116 aa, Artificial Sequence; identical to SEQ ID NO: 1332
  Description of Artificial Sequence: Synthetic polypeptide

SEQ ID NO: 2291 - protein, 123 aa, Artificial Sequence; identical to SEQ ID NO: 1333
  Description of Artificial Sequence: Synthetic polypeptide

SEQ ID NO: 2292 - protein, 120 aa, Artificial Sequence; identical to SEQ ID NO: 1334
  Description of Artificial Sequence: Synthetic polypeptide

SEQ ID NO: 2293 - protein, 128 aa, Artificial Sequence; identical to SEQ ID NO: 1335
  Description of Artificial Sequence: Synthetic polypeptide

SEQ ID NO: 2294 - protein, 116 aa, Artificial Sequence; identical to SEQ ID NO: 1336
  Description of Artificial Sequence: Synthetic polypeptide

SEQ ID NO: 2295 - protein, 122 aa, Artificial Sequence; identical to SEQ ID NO: 1337
  Description of Artificial Sequence: Synthetic polypeptide

SEQ ID NO: 2296 - protein, 114 aa, Artificial Sequence; identical to SEQ ID NO: 1338
  Description of Artificial Sequence: Synthetic polypeptide

SEQ ID NO: 2297 - protein, 125 aa, Artificial Sequence; identical to SEQ ID NO: 1339
  Description of Artificial Sequence: Synthetic polypeptide

SEQ ID NO: 2298 - protein, 120 aa, Artificial Sequence; identical to SEQ ID NO: 1340
  Description of Artificial Sequence: Synthetic polypeptide

SEQ ID NO: 2299 - protein, 119 aa, Artificial Sequence; identical to SEQ ID NO: 1341
  Description of Artificial Sequence: Synthetic polypeptide

SEQ ID NO: 2300 - protein, 125 aa, Artificial Sequence; identical to SEQ ID NO: 1342
  Description of Artificial Sequence: Synthetic polypeptide

SEQ ID NO: 2301 - protein, 119 aa, Artificial Sequence; identical to SEQ ID NO: 1343
  Description of Artificial Sequence: Synthetic polypeptide

SEQ ID NO: 2302 - protein, 121 aa, Artificial Sequence
  Description of Artificial Sequence: Synthetic polypeptide
EVQLVESGGGLVQPGGSLRLSCAASGFTLGDYVMGWFRQAPGKEREFVAAIHSGGSTYADSVKGRFTISADNSKNTAYLQMNSLKPEDTAVYYCAAKEYGGTRRYDRAYNWGQGTLVTVSS

SEQ ID NO: 2303 - protein, 115 aa, Artificial Sequence
  Description of Artificial Sequence: Synthetic polypeptide
EVQLVESGGGLVQPGGSLRLSCAASGGGTFGSYAMGWFRQAPGKERELVAAISSGGSTNYADSVKGRFTISADNSKNTAYLQMNSLKPEDTAVYYCARGDWRYGWGQGTLVTVSS

SEQ ID NO: 2304 - protein, 124 aa, Artificial Sequence
  Description of Artificial Sequence: Synthetic polypeptide
EVQLVESGGGLVQPGGSLRLSCAASGRTYSISAMGWFRQAPGKEREFVAAISMSGDDSAYADSVKGRFTISADNSKNTAYLQMNSLKPEDTAVYYCAAQLGYESGYSLTYDYDWGQGTLVTVSS

SEQ ID NO: 2305 - protein, 123 aa, Artificial Sequence
  Description of Artificial Sequence: Synthetic polypeptide
EVQLVESGGGLVQPGGSLRLSCAASGGTFSTYPMGWFRQAPGKEREFVAAITSDGSTLYADSVKGRFTISADNSKNTAYLQMNSLKPEDTAVYYCAATDYNKAYAREGRRYDWGQGTLVTVSS

SEQ ID NO: 2306 - protein, 123 aa, Artificial Sequence
  Description of Artificial Sequence: Synthetic polypeptide
EVQLVESGGGLVQPGGSLRLSCAASGSIFRINAMGWFRQAPGKEREFVAAIHWSGSSTRYADSVKGRFTISADNSKNTAYLQMNSLKPEDTAVYYCAAQDRRRGDYYTFDYHWGQGTLVTVSS

SEQ ID NO: 2307 - protein, 114 aa, Artificial Sequence
  Description of Artificial Sequence: Synthetic polypeptide
EVQLVESGGGLVQPGGSLRLSCAASGGTFNNYAMGWFRQAPGKERELVAAITSGGSTDYADSVKGRFTISADNSKNTAYLQMNSLKPEDTAVYYCARGDWRYGWGQGTLVTVSS

SEQ ID NO: 2308 - protein, 116 aa, Artificial Sequence
  Description of Artificial Sequence: Synthetic polypeptide
EVQLVESGGGLVQPGGSLRLSCAASGTIVNINVMGWFRQAPGKEREFVAAIHWSGGLKAYADSVKGRFTISADNSKNTAYLQMNSLKPEDTAVYYCAMNRAGIYEWGQGTLVTVSS

SEQ ID NO: 2309 - protein, 114 aa, Artificial Sequence
  Description of Artificial Sequence: Synthetic polypeptide
EVQLVESGGGLVQPGGSLRLSCAASGSTFSNYAMGWFRQAPGKERELVAAITSGGSTSYADSVKGRFTISADNSKNTAYLQMNSLKPEDTAVYYCARGDWRYGWGQGTLVTVSS

SEQ ID NO: 2310 - protein, 123 aa, Artificial Sequence
  Description of Artificial Sequence: Synthetic polypeptide
EVQLVESGGGLVQPGGSLRLSCAASGFSFDDYVMGWFRQAPGKEREFVAAISRSGNLKSYADSVKGRFTISADNSKNTAYLQMNSLKPEDTAVYYCAAKEYGGTRRYDRAYNWGQGTLVTVSS

SEQ ID NO: 2311 - protein, 115 aa, Artificial Sequence
  Description of Artificial Sequence: Synthetic polypeptide
EVQLVESGGGLVQPGGSLRLSCAASGSAFRSTVMGWFRQAPGKEREFVAAVIGSSGITDYADSVKGRFTISADNSKNTAYLQMNSLKPEDTAVYYCARGDWRYGWGQGTLVTVSS

SEQ ID NO: 2312 - protein, 116 aa, Artificial Sequence
  Description of Artificial Sequence: Synthetic polypeptide
EVQLVESGGGLVQPGGSLRLSCAASGRTFSDAGMGWFRQAPGKEREFVAAISRSGNLKAYADSVKGRFTISADNSKNTAYLQMNSLKPEDTAVYYCAVQVNGTWAWGQGTLVTVSS

SEQ ID NO: 2313 - protein, 115 aa, Artificial Sequence
  Description of Artificial Sequence: Synthetic polypeptide
EVQLVESGGGLVQPGGSLRLSCAASGFTLDYYAMGWFRQAPGKERELVAAISWNGGSTSYADSVKGRFTISADNSKNTAYLQMNSLKPEDTAVYYCARGDWRYGWGQGTLVTVSS

SEQ ID NO: 2314 - protein, 120 aa, Artificial Sequence
  Description of Artificial Sequence: Synthetic polypeptide
EVQLVESGGGLVQPGGSLRLSCAASGGTFSTYVMGWFRQAPGKEREFVAAISWSGESTLYADSVKGRFTISADNSKNTAYLQMNSLKPEDTAVYYCAADLMYGVDRRYDWGQGTLVTVSS

SEQ ID NO: 2315 - protein, 114 aa, Artificial Sequence
  Description of Artificial Sequence: Synthetic polypeptide
EVQLVESGGGLVQPGGSLRLSCAASGISSSKRNMGWFRQAPGKEREFVAGISWTGGITYYADSVKGRFTISADNSKNTAYLQMNSLKPEDTAVYYCAIAGRGRWGQGTLVTVSS

SEQ ID NO: 2316 - protein, 122 aa, Artificial Sequence
  Description of Artificial Sequence: Synthetic polypeptide
EVQLVESGGGLVQPGGSLRLSCAASGRRFSAYGMGWFRQAPGKEREFVAVISRSGTLTRYADSVKGRFTISADNSKNTAYLQMNSLKPEDTAVYYCASSGPADARNGERWHWGQGTLVTVSS

SEQ ID NO: 2317 - protein, 123 aa, Artificial Sequence
  Description of Artificial Sequence: Synthetic polypeptide
EVQLVESGGGLVQPGGSLRLSCAASGLTFSSFVMGWFRQAPGKEREFVAAISSNGGSTRYADSVKGRFTISADNSKNTAYLQMNSLKPEDTAVYYCAAKEYGGTRRYDRAYNWGQGTLVTVSS

SEQ ID NO: 2318 - protein, 124 aa, Artificial Sequence
  Description of Artificial Sequence: Synthetic polypeptide
EVQLVESGGGLVQPGGSLRLSCAASGTVFSISAMGWFRQAPGKEREFVAAISMSGDDTAYADSVKGRFTISADNSKNTAYLQMNSLKPEDTAVYYCAAQLGYESGYSLTYDYDWGQGTLVTVSS

SEQ ID NO: 2319 - protein, 117 aa, Artificial Sequence
  Description of Artificial Sequence: Synthetic polypeptide
EVQLVESGGGLVQPGGSLRLSCAASGSIFSPNVMGWFRQAPGKEREFVAAITNGGSTKYADSVKGRFTISADNSKNTAYLQMNSLKPEDTAVYYCAAQRWRGGSYEWGQGTLVTVSS

SEQ ID NO: 2320 - protein, 123 aa, Artificial Sequence
  Description of Artificial Sequence: Synthetic polypeptide
EVQLVESGGGLVQPGGSLRLSCAASGIPASIRVMGWFRQAPGKEREFVAAIHWSGSSTRYADSVKGRFTISADNSKNTAYLQMNSLKPEDTAVYYCALSRAIVPGDSEYDYRWGQGTLVTVSS

SEQ ID NO: 2321 - protein, 124 aa, Artificial Sequence
  Description of Artificial Sequence: Synthetic polypeptide
EVQLVESGGGLVQPGGSLRLSCAASGRTFSMSAMGWFRQAPGKEREFVSAISWSGGSTLYADSVKGRFTISADNSKNTAYLQMNSLKPEDTAVYYCAAQLGYESGYSLTYDYDWGQGTLVTVSS

SEQ ID NO: 2322 - protein, 114 aa, Artificial Sequence
  Description of Artificial Sequence: Synthetic polypeptide
EVQLVESGGGLVQPGGSLRLSCAASGRTFSNYAMGWFRQAPGKERELVAAITSGGSTDYADSVKGRFTISADNSKNTAYLQMNSLKPEDTAVYYCARGDWRYGWGQGTLVTVSS

SEQ ID NO: 2323 - protein, 114 aa, Artificial Sequence
  Description of Artificial Sequence: Synthetic polypeptide
EVQLVESGGGLVQPGGSLRLSCAASGRTFSSYAMGWFRQAPGKERELVAAISTGGSTYYADSVKGRFTISADNSKNTAYLQMNSLKPEDTAVYYCARGDWRYGWGQGTLVTVSS

SEQ ID NO: 2324 - protein, 122 aa, Artificial Sequence
  Description of Artificial Sequence: Synthetic polypeptide
EVQLVESGGGLVQPGGSLRLSCAASGRSFSSVGMGWFRQAPGKEREFVAVISRSGASTAYADSVKGRFTISADNSKNTAYLQMNSLKPEDTAVYYCASAGPADARNGERWAWGQGTLVTVSS

SEQ ID NO: 2325 - protein, 117 aa, Artificial Sequence
  Description of Artificial Sequence: Synthetic polypeptide
EVQLVESGGGLVQPGGSLRLSCAASGRAFRRYTMGWFRQAPGKERELIAVINWSGDRRYYADSVKGRFTISADNSKNTAYLQMNSLKPEDTAVYYCAATLAKGGGRWGQGTLVTVSS

SEQ ID NO: 2326 - protein, 121 aa, Artificial Sequence
  Description of Artificial Sequence: Synthetic polypeptide
EVQLVESGGGLVQPGGSLRLSCAAMAWAGFARRRAKNAKWWRALPRGGPTYADSVKGRFTISADNSKNTAYLQMNSLKPEDTAVYYCAAGGMWYGSSLYVRFDLLEDGMDWGQGTLVTVSS

SEQ ID NO: 2327 - protein, 122 aa, Artificial Sequence
  Description of Artificial Sequence: Synthetic polypeptide
EVQLVESGGGLVQPGGSLRLSCAASGSISSINGMGWFRQAPGKERELVALISRSGGTTYYADSVKGRFTISADNSKNTAYLQMNSLKPEDTAVYYCASAGPADARNGERWAWGQGTLVTVSS

SEQ ID NO: 2328 - protein, 114 aa, Artificial Sequence
  Description of Artificial Sequence: Synthetic polypeptide
EVQLVESGGGLVQPGGSLRLSCAASGRTFSNNVMGWFRQAPGKERELVAAAISGGSTYYADSVKGRFTISADNSKNTAYLQMNSLKPEDTAVYYCARGDWRYGWGQGTLVTVSS

SEQ ID NO: 2329 - protein, 123 aa, Artificial Sequence
  Description of Artificial Sequence: Synthetic polypeptide
EVQLVESGGGLVQPGGSLRLSCAASGRTFSISAMGWFRQAPGKEREFVAAISRSGTTMYADSVKGRFTISADNSKNTAYLQMNSLKPEDTAVYYCAAQLGYESGYSLTYDYDWGQGTLVTVSS

SEQ ID NO: 2330 - protein, 125 aa, Artificial Sequence
  Description of Artificial Sequence: Synthetic polypeptide
EVQLVESGGGLVQPGGSLRLSCAASGGTFSYYDLAAMGWFRQAPGKEREFVAAISWSQYNTKYADSVKGRFTISADNSKNTAYLQMNSLKPEDTAVYYCAARVVVRTAHGFEDNWGQGTLVTVSS

SEQ ID NO: 2331 - protein, 119 aa, Artificial Sequence
  Description of Artificial Sequence: Synthetic polypeptide
EVQLVESGGGLVQPGGSLRLSCAASGRTFNNYGMGWFRQAPGKEREFVAVISRSGSLKAYADSVKGRFTISADNSKNTAYLQMNSLKPEDTAVYYCASDPTYGSGRWTWGQGTLVTVSS

SEQ ID NO: 2332 - protein, 123 aa, Artificial Sequence
  Description of Artificial Sequence: Synthetic polypeptide
EVQLVESGGGLVQPGGSLRLNCAASGFTLDDYVMGWFRQTPGKEREFVAAISSSGALTSYADSVKGRFTISADNSKNTAYLQMNSLKPEDAAVYYCAAKEYGGTRRYDRAYNWGQGTLVTVSS

SEQ ID NO: 2333 - protein, 121 aa, Artificial Sequence
  Description of Artificial Sequence: Synthetic polypeptide
EVQLVESGGGLVQPGGSLRLSCAASGRTFNAMGWFRQAPGKEREFVAAIRWSGDMSVYADSVKGRFTISADNSKNTAYLQMNSLKPEDTAVYYCAAQDRRRGDYYTFDYHWGQGTLVTVSS

SEQ ID NO: 2334 - protein, 114 aa, Artificial Sequence
  Description of Artificial Sequence: Synthetic polypeptide
EVQLVESGGGLVQPGGSLRLSCAASGLTFSTYAMGWFRQAPGKEREFVAAITSGGSTDYADSVKGRFTISADNSKNTAYLQMNSLKPEDTAVYYCARGDWRYGWGQGTLVTVSS

SEQ ID NO: 2335 - protein, 114 aa, Artificial Sequence
  Description of Artificial Sequence: Synthetic polypeptide
EVQLVESGGGLVQPGGSLRLSCAASGSIFTINAMGWFRQAPGKEREGVAAIGSDGSTSYADSVKGRFTISADNSKNTAYLQMNSLKPEDTAVYYCAVVRWGADWGQGTLVTVSS

SEQ ID NO: 2336 - protein, 116 aa, Artificial Sequence
  Description of Artificial Sequence: Synthetic polypeptide
EVQLVESGGGLVQPGGSLRLSCAASGLTFSSYAMGWFRQAPGKERELVAAITSSSGSTPAYADSVKGRFTISADNSKNTAYLQMNSLKPEDTAVYYCARGDWRYGWGQGTLVTVSS

SEQ ID NO: 2337 - protein, 123 aa, Artificial Sequence
  Description of Artificial Sequence: Synthetic polypeptide
EVQLVESGGGLVQPGGSLRLSCAASGIPFSTRTMGWFRQAPGKEREFVAAISWSQYNTKYADSVKGRFTISADNSKNTAYLQMNSLKPEDTAVYYCAARHWGMFSRSENDYNWGQGTLVTVSS

SEQ ID NO: 2338 - protein, 125 aa, Artificial Sequence
  Description of Artificial Sequence: Synthetic polypeptide
EVQLVESGGGLVQPGGSLRLSCAASGRSRFSTYVMGWFRQAPGKEREFVAAISWSQYNTKYADSVKGRFTISADNSKNTAYLQMNSLKPEDTAVYYCAAGNGGRNYGHSRARYDWGQGTLVTVSS

SEQ ID NO: 2339 - protein, 118 aa, Artificial Sequence
  Description of Artificial Sequence: Synthetic polypeptide
EVQLVESGGGLVQPGGSLRLSCAASGLTLSSYGMGWFRQAPGKEREYVAVISRSGSLKAYADSVKGRFTISADNSKNTAYLQMNSLKPEDTAVYYCATRADAEGWWDWGQGTLVTVSS

SEQ ID NO: 2340 - protein, 113 aa, Artificial Sequence
  Description of Artificial Sequence: Synthetic polypeptide
EVQLVESGGGLVQPGGSLRLSCAASGSIFRVNVMGWFRQAPGKEREFVAAINNFGTTKYADSVKGRFTISADNSKNTAYLQMNSLKPEDTAVYYCAADLPSRWGQGTLVTVSS

SEQ ID NO: 2341 - protein, 114 aa, Artificial Sequence
  Description of Artificial Sequence: Synthetic polypeptide
EVQLVESGGGLVQPGGSLRLSCAASGRTFRNYAMGWFRQAPGKERELVAAISSGGSTDYADSVKGRFTISADNSKNTAYLQMNSLKPEDTAVYYCARGDWRYGWGQGTLVTVSS

SEQ ID NO: 2342 - protein, 114 aa, Artificial Sequence
  Description of Artificial Sequence: Synthetic polypeptide
EVQLVESGGGLVQPGGSLRLSCAASGRTFSSFAMGWFRQAPGKERELVAAISSGGSTNYADSVKGRFTISADNSKNTAYLQMNSLKPEDTAVYYCARGDWRYGWGQGTLVTVSS

SEQ ID NO: 2343 - protein, 123 aa, Artificial Sequence
  Description of Artificial Sequence: Synthetic polypeptide
EVQLVESGGGLVQPGGSLRLSCAASGTTFRINAMGWFRQAPGKEREFVAAMNWSGGSTKYADSVKGRFTISADNSKNTAYLQMNSLKPEDTAVYYCAAQDRRRGDYYTFDYHWGQGTLVTVSS

SEQ ID NO: 2344 - protein, 122 aa, Artificial Sequence
  Description of Artificial Sequence: Synthetic polypeptide
EVQLVESGGGLVQPGGSLRLSCAASGFTLGDYVMGWFRQAPGKEREFVAAIHSGGSTLYADSVKGRFTISADNSKNTAYLQMNSLKPEDTAVYYCAAKEYGGTRRYDRTYNWGQGTLVTVSS

SEQ ID NO: 2345 - protein, 112 aa, Artificial Sequence
  Description of Artificial Sequence: Synthetic polypeptide
EVQLVESGGGLVQPGGSLRLSCAASGFTFSRSAMGWFRQAPGKERELVAGILSSGATVYADSVKGRFTISADNSKNTAYLQMNSLKPEDTAVYYCAKAPRDWGQGTLVTVSS

SEQ ID NO: 2346 - protein, 114 aa, Artificial Sequence
  Description of Artificial Sequence: Synthetic polypeptide
EVQLVESGGGLVQPGGSLRLSCAASGRTFNNYAMGWFRQAPGKERELVAAITSGGSTDYADSVKGRFTISADNSKNTAYLQMNSLKPEDTAVYYCARGDWRYGWGQGTLVTVSS

SEQ ID NO: 2347 - protein, 116 aa, Artificial Sequence
  Description of Artificial Sequence: Synthetic polypeptide
EVQLVESGGGLVQPGGSLRLSCAASGFTFRSYPMGWFRQAPGKEREFVAAINNFGTTKYADSVKGRFTISADNSKNTAYLQMNSLKPEDTAVYYCAAAKGIGVYGWGQGTLVTVSS

SEQ ID NO: 2348 - protein, 121 aa, Artificial Sequence
  Description of Artificial Sequence: Synthetic polypeptide
EVQLVESGGGLVQPGGSLRLSCAASGNIFTRNVMGWFRQAPGKEREFVAAIHWNGDSTKYADSVKGRFTISADNSKNTAYLQMNSLKPEDTAVYYCAAGSNIGGSRWRYDWGQGTLVTVSS

SEQ ID NO: 2349 - protein, 123 aa, Artificial Sequence
  Description of Artificial Sequence: Synthetic polypeptide
EVQLVESGGGLVQPGGSLRLSCAASGRTISRYTMGWFRQAPGKERELVAAIKWSGASTVYADSVKGRFTISADNSKNTAYLQMNSLKPEDTAVYYCAAKGIWDYLGRRDFGDWGQGTLVTVSS

SEQ ID NO: 2350 - protein, 124 aa, Artificial Sequence
  Description of Artificial Sequence: Synthetic polypeptide
EVQLVESGGGLVQPGGSLRLSCAASGFRFSSYGMGWFRQAPGKEREFVAIITSGGLTVYADSVKGRFTISADNSKNTAYLQMNSLKPEDTAVYYCAARKTFYFGTSSYPNDYAWGQGTLVTVSS

SEQ ID NO: 2351 - protein, 114 aa, Artificial Sequence
  Description of Artificial Sequence: Synthetic polypeptide
EVQLVESGGGLVQPGGSLRLSCAASGRTFDNHAMGWFRQAPGKEREGVAAIGSDGSTSYADSVKGRFTISADNSKNTAYLQMNSLKPEDTAVYYCAVVRWGVDWGQGTLVTVSS

SEQ ID NO: 2352 - protein, 115 aa, Artificial Sequence
  Description of Artificial Sequence: Synthetic polypeptide
EVQLVESGGGLVQPGGSLRLSCAASGFTFSSHAMGWFRQAPGKEREFVAGISWSGESTLTRYADSVKGRFTISADNSKNTAYLQMNSLKPEDTAVYYCADVNGDWGQGTLVTVSS

SEQ ID NO: 2353 - protein, 124 aa, Artificial Sequence
  Description of Artificial Sequence: Synthetic polypeptide
EVQLVESGGGLVQPGGSLRLSCAASGMTFRLYAMGWFRQAPGKEREFVAAISWSQYNTKYADSVKGRFTISADNSKNTAYLQMNSLKPEDTAVYYCAAQLGYESGYSLTYDYDWGQGTLVTVSS

SEQ ID NO: 2354 - protein, 115 aa, Artificial Sequence
  Description of Artificial Sequence: Synthetic polypeptide
EVQLVESGGGLVQPGGSLRLSCAASGGTFRKLAMGWFRQAPGKEREFVAVISWTGGSSYYADSVKGRFTISADNSKNTAYLQMNSLKPEDTAVYYCARLTSFATWGQGTLVTVSS

SEQ ID NO: 2355 - protein, 118 aa, Artificial Sequence
  Description of Artificial Sequence: Synthetic polypeptide
EVQLVESGGGLVQPGGSLRLSCAASGRTFSANGMGWFRQAPGKEREFVAAISASGTLRAYADSVKGRFTISADNSKNTAYLQMNSLKPEDTAVYYCAARSPMSPTWDWGQGTLVTVSS

SEQ ID NO: 2356 - protein, 121 aa, Artificial Sequence
  Description of Artificial Sequence: Synthetic polypeptide
EVQLVESGGGLVQPGGSLRLSCAASGSAFRSTVMGWFRQAPGKEREFVAAISWTGESTLYADSVKGRFTISADNSKNTAYLQMNSLKPEDTAVYYCATGPYRSYFARSYLWGQGTLVTVSS

SEQ ID NO: 2357 - protein, 117 aa, Artificial Sequence
  Description of Artificial Sequence: Synthetic polypeptide
EVQLVESGGGLVQPGGSLRLSCAASGGTFDYSGMGWFRQAPGKEREFVAVVSQSGRTTYYADSVKGLFTITADNSKNTAYLQMNLLKPEDTAVYYCPTATRPGEWDGGQGTLVTVSR

SEQ ID NO: 2358 - protein, 111 aa, Artificial Sequence
  Description of Artificial Sequence: Synthetic polypeptide
EVQLVESGGGLVQPGGSLRLSCAASGVFGPIRAMGWFRQAPGKERELVALMGNDGSTYADSVKGRFTISADNSKNTAYLQMNSLKPEDTAVYYCAAIGWRWGQGTLVTVSS

SEQ ID NO: 2359 - protein, 121 aa, Artificial Sequence
  Description of Artificial Sequence: Synthetic polypeptide
EVQLVESGGGLVQPGGSLRLSCAASGFNFNWYPMGWFRQAPGKEREFVAAIRWSGGITYYADSVKGRFTISADNSKNTAYLQMNSLKPEDTAVYYCATGPYRSYFARSYLWGQGTLVTVSS

SEQ ID NO: 2360 - protein, 112 aa, Artificial Sequence
  Description of Artificial Sequence: Synthetic polypeptide
EVQLVESGGGLVQPGGSLRLSCAASGMTFHRYVMGWFRQAPGKERELVASITTGGTPNYADSVKGRFTIITDNNKNTAYLLMINLQPEDTAVYYCCKVPYIWGQGTLGTVGT

SEQ ID NO: 2361 - protein, 113 aa, Artificial Sequence
  Description of Artificial Sequence: Synthetic polypeptide
EVQLVESGGGLVQPGGSLRLSCAASGISTMGWFRQAPGKEREFVAAINNFGTTKYADSVKGRFTISADNSKNTAYLQMNSLKPEDTAVYYCAAASQSGSGYDWGQGTLVTVSS

SEQ ID NO: 2362 - protein, 111 aa, Artificial Sequence
  Description of Artificial Sequence: Synthetic polypeptide
EVQLVESGGGLVQPGGSLRLSCAASGRAFNTRAMGWFRQAPGKERELVALMGNDGSTYADSVKGRFTISADNSKNTAYLQMNSLKPEDTAVYYCAAIGWRWGQGTLVTVSS

SEQ ID NO: 2363 - protein, 123 aa, Artificial Sequence
  Description of Artificial Sequence: Synthetic polypeptide
EVQLVESGGGLVQPGGSLRLSCAASGLTDRRYTMGWFRQAPGKEREFVAAINSGGSTLYADSVKGRFTISADNSKNTAYLQMNSLKPEDTAVYYCAAGNGGRTYGHSRARYEWGQGTLVTVSS

SEQ ID NO: 2364 - protein, 111 aa, Artificial Sequence
  Description of Artificial Sequence: Synthetic polypeptide
EVQLVESGGGLVQPGGSLRLSCAASGRTFNVMGWFRQAPGKERELVALMGNDGSTYADSVKGRFTISADNSKNTAYLQMNSLKPEDTAVYYCAAVRWGVDWGQGTLVTVSS

SEQ ID NO: 2365 - protein, 112 aa, Artificial Sequence
  Description of Artificial Sequence: Synthetic polypeptide
EVQLVESGGGLVQPGGSLRLSCAASGRAFNTRAMGWFRQAPGKERELVALMGNDGSTNYADSVKGRFTISADNSKNTAYLQMNSLKPEDTAVYYCAAIGWRWGQGTLVTVSS

SEQ ID NO: 2366 - protein, 117 aa, Artificial Sequence
  Description of Artificial Sequence: Synthetic polypeptide
EVQVVESGGGVVHPGGSVRMRCAASGVTVDYSGMGWFGQAPGKEREFVAVVSQSARTTYYADSVKGRFTISADNSKNTEYLQMNSMKPEDTAVYYCATATRPGEWDWGQGTLVTVSS

SEQ ID NO: 2367 - protein, 124 aa, Artificial Sequence
  Description of Artificial Sequence: Synthetic polypeptide
EVQLVESGGGLVQPGGSLRLSCAASGRTPRLGAMGWFRQAPGKEREFVAAISRSGGLTSYADSVKGRFTISADNSKNTAYLQMNSLKPEDTAVYYCAAQLVGSNIGGSRWRYDWGQGTLVTVSS

SEQ ID NO: 2368 - protein, 114 aa, Artificial Sequence
  Description of Artificial Sequence: Synthetic polypeptide
EVQLVESGGGLVQPGGSLRLSCAASGLTFRNYAMGWFRQAPGKEREFVAAITSGGSTLYADSVKGRFTISADNSKNTAYLQMNSLKPEDTAVYYCARGDWRYGWGHGTLVTESS

SEQ ID NO: 2369 - protein, 114 aa, Artificial Sequence
  Description of Artificial Sequence: Synthetic polypeptide
EVQLVESGGGLVQPGGSLRLSCAASGGRTFSDLAMGWFRQAPGKEREFVALITRSGGTTFYADSVKGRFTISADNSKNTAYLQMNSLKPEDTAVYYCAIGRGSWGQGTLVTVSS

SEQ ID NO: 2370 - protein, 117 aa, Artificial Sequence
  Description of Artificial Sequence: Synthetic polypeptide
EVQLVESGGGLVQPGGSLRLSCAASGFTFGEYAMGWFRQAPGKEREFVAAVSSLGPFTRYADSVKGRFTISADNSKNTAYLQMNSLKPEDTAVYYCAAVLDGYSGSWGQGTLVTVSS

SEQ ID NO: 2371 - protein, 124 aa, Artificial Sequence
  Description of Artificial Sequence: Synthetic polypeptide
EVQLVESGGGLVQPGGSLRLSCAASGFAFSSYGMGWFRQAPGKEREFVAAISWSGVRSGVSAIYADSVKGRFTISADNSKNTAYLQMNSLKPEDTAVYYCTTDLTGDLWYFDLWGQGTLVTVSS

SEQ ID NO: 2372 - protein, 119 aa, Artificial Sequence
  Description of Artificial Sequence: Synthetic polypeptide
EVQLVESGGGLVQPGGSLRLSCAASGLTAGTYAMCWFRQAPGKEREGVACASSTDGSTAYADSVKGRFTISADNSKNTAYLQMNSLKPEDTAVYYCAAVRTYGSATYDWGQGTLVTVSS

SEQ ID NO: 2373 - protein, 123 aa, Artificial Sequence
  Description of Artificial Sequence: Synthetic polypeptide
EVQLVESGGGLVQPGGSLRLSCAASGFTLDDYVMGWFRQAPGKERELVAAVSSLGPFTRYADSVKGRFTISADNSKNTAYLQMNSLKPEDTAVYYCAAKEYGGTRRYDRAYNWGQGTLVTVSS

SEQ ID NO: 2374 - protein, 118 aa, Artificial Sequence
  Description of Artificial Sequence: Synthetic polypeptide
EVQLVESGGGLVQPGGSLRLSCAASGPTLGSYVMGWFRQAPGKEREFVAAISWSQYNTKYADSVKGRFTISADNSKNTAYLQMNSLKPEDTAVYYCAAQRWRGGSYEWGQGTLVTVSS

SEQ ID NO: 2375 - protein, 118 aa, Artificial Sequence
  Description of Artificial Sequence: Synthetic polypeptide
EVQLVESGGGLVQPGGSLRLSCAASGPTFSSYVMGWFRQAPGKEREFVAAISWSQYNTKYADSVKGRFTISADNSKNTAYLQMNSLKPEDTAVYYCAAASRSGSGYDWGQGTLVTVSS

SEQ ID NO: 2376 - protein, 120 aa, Artificial Sequence
  Description of Artificial Sequence: Synthetic polypeptide
EVQLVESGGGLVQPGGSLRLSCAASGYLYSKDCMGWFRQAPGKEREGVATICTGDGSTAYADSVKGRFTISADNSKNTAYLQMNSLKPEDTAVYYCAVIAYEEGVYRWDWGQGTLVTVSS

SEQ ID NO: 2377 - protein, 117 aa, Artificial Sequence
  Description of Artificial Sequence: Synthetic polypeptide
EVQLVESGGGLVQPGGSLRLSCAASGFTIDDYAMGWFRQAPGKEREGVAAISGSGDDTYYADSVKGRFTISADNSKNTAYLQMNSLKPEDTAVYYCAKLPYVSGDYWGQGTLVTVSS

SEQ ID NO: 2378 - protein, 116 aa, Artificial Sequence
  Description of Artificial Sequence: Synthetic polypeptide
EVQLVESGGGLVQPGGSLRLSCAASGGRFSDYGMGWFRQAPGKERELVALISRSGNLKSYADSVKGRFTISADNSKNTAYLQMNSLKPEDTAVYYCAAKTGTSFVWGQGTLVTVSS

SEQ ID NO: 2379 - protein, 114 aa, Artificial Sequence
  Description of Artificial Sequence: Synthetic polypeptide
EVQLVESGGGLVQPGGSLRLSCAASGLSFSNYAMGWFRQAPGKERELVAAITSGGSTDYADSVKGRFTISADNSKNTAYLQMNSLKPEDTAVYYCARGDWRYGWGQGTLVTVSS

SEQ ID NO: 2380 - protein, 113 aa, Artificial Sequence
  Description of Artificial Sequence: Synthetic polypeptide
EVQLVESGGGLVQPGGSLRLSCAASGIPSTLRAMGWFRQAPGKEREFVALINRSGGSQFYADSVKGRFTISADNSKNTAYLQMNSLKPEDTAVYYCAIGRGSWGQGTLVTVSS

SEQ ID NO: 2381 - protein, 9 aa, Artificial Sequence
  Description of Artificial Sequence: Synthetic peptide
RTFSRLAMG

SEQ ID NO: 2382 - protein, 8 aa, Artificial Sequence
  Description of Artificial Sequence: Synthetic peptide
SFSIAAMG

SEQ ID NO: 2383 - protein, 9 aa, Artificial Sequence
  Description of Artificial Sequence: Synthetic peptide
RTFSRYAMG

SEQ ID NO: 2384 - protein, 9 aa, Artificial Sequence
  Description of Artificial Sequence: Synthetic peptide
RTFSKYAMG

SEQ ID NO: 2385 - protein, 9 aa, Artificial Sequence
  Description of Artificial Sequence: Synthetic peptide
RTFRRYAMG

SEQ ID NO: 2386 - protein, 9 aa, Artificial Sequence
  Description of Artificial Sequence: Synthetic peptide
RTFSRFAMG

SEQ ID NO: 2387 - protein, 12 aa, Artificial Sequence
  Description of Artificial Sequence: Synthetic peptide
LGIAFSRRTAMG

SEQ ID NO: 2388 - protein, 9 aa, Artificial Sequence
  Description of Artificial Sequence: Synthetic peptide
RTFRRYPMG

SEQ ID NO: 2389 - protein, 9 aa, Artificial Sequence
  Description of Artificial Sequence: Synthetic peptide
GTLRGYGMG

SEQ ID NO: 2390 - protein, 9 aa, Artificial Sequence
  Description of Artificial Sequence: Synthetic peptide
RMFSSRSMG

SEQ ID NO: 2391 - protein, 9 aa, Artificial Sequence
  Description of Artificial Sequence: Synthetic peptide
RTFGRRAMG

SEQ ID NO: 2392 - protein, 12 aa, Artificial Sequence
  Description of Artificial Sequence: Synthetic peptide
LSSPPFDDFPMG

SEQ ID NO: 2393 - protein, 9 aa, Artificial Sequence
  Description of Artificial Sequence: Synthetic peptide
GTFSSYSMG

SEQ ID NO: 2394 - protein, 9 aa, Artificial Sequence
  Description of Artificial Sequence: Synthetic peptide
SIFSTRTMG

SEQ ID NO: 2395 - protein, 9 aa, Artificial Sequence
  Description of Artificial Sequence: Synthetic peptide
RTLWRSNMG

SEQ ID NO: 2396 - protein, 9 aa, Artificial Sequence
  Description of Artificial Sequence: Synthetic peptide
RSLGIYRMG

SEQ ID NO: 2397 - protein, 9 aa, Artificial Sequence
  Description of Artificial Sequence: Synthetic peptide
TTLTFRIMG

SEQ ID NO: 2398 - protein, 13 aa, Artificial Sequence
  Description of Artificial Sequence: Synthetic peptide
SRFSGRFNILNMG

SEQ ID NO: 2399 - protein, 9 aa, Artificial Sequence
  Description of Artificial Sequence: Synthetic peptide
TLFKINAMG

SEQ ID NO: 2400 - protein, 9 aa, Artificial Sequence
  Description of Artificial Sequence: Synthetic peptide
IPFRSRTMG

SEQ ID NO: 2401 - protein, 9 aa, Artificial Sequence
  Description of Artificial Sequence: Synthetic peptide
FTFSSFRMG

SEQ ID NO: 2402 - protein, 9 aa, Artificial Sequence
  Description of Artificial Sequence: Synthetic peptide
RNFRRNSMG

SEQ ID NO: 2403 - protein, 9 aa, Artificial Sequence
  Description of Artificial Sequence: Synthetic peptide
RNLRMYRMG

SEQ ID NO: 2404 - protein, 10 aa, Artificial Sequence
  Description of Artificial Sequence: Synthetic peptide
GLTFSSNTMG

SEQ ID NO: 2405 - protein, 9 aa, Artificial Sequence
  Description of Artificial Sequence: Synthetic peptide
FTLAYYAMG

SEQ ID NO: 2406 - protein, 9 aa, Artificial Sequence
  Description of Artificial Sequence: Synthetic peptide
RTFSSFPMG

SEQ ID NO: 2407 - protein, 9 aa, Artificial Sequence
  Description of Artificial Sequence: Synthetic peptide
ISSSKRNMG

SEQ ID NO: 2408 - protein, 9 aa, Artificial Sequence
  Description of Artificial Sequence: Synthetic peptide
RTFSIYAMG

SEQ ID NO: 2409 - protein, 9 aa, Artificial Sequence
  Description of Artificial Sequence: Synthetic peptide
RMYNSYSMG

SEQ ID NO: 2410 - protein, 9 aa, Artificial Sequence
  Description of Artificial Sequence: Synthetic peptide
RTFRSYGMG

SEQ ID NO: 2411 - protein, 7 aa, Artificial Sequence
  Description of Artificial Sequence: Synthetic peptide
RTIRTMG

SEQ ID NO: 2412 - protein, 9 aa, Artificial Sequence
  Description of Artificial Sequence: Synthetic peptide
RSFSFNAMG

SEQ ID NO: 2413 - protein, 7 aa, Artificial Sequence
  Description of Artificial Sequence: Synthetic peptide
RTYYAMG

SEQ ID NO: 2414 - protein, 9 aa, Artificial Sequence
  Description of Artificial Sequence: Synthetic peptide
RAFRRYTMG

SEQ ID NO: 2415 - protein, 9 aa, Artificial Sequence
  Description of Artificial Sequence: Synthetic peptide
RTFSNYRMG

SEQ ID NO: 2416 - protein, 9 aa, Artificial Sequence
  Description of Artificial Sequence: Synthetic peptide
ITFSPYAMG

SEQ ID NO: 2417 - protein, 14 aa, Artificial Sequence
  Description of Artificial Sequence: Synthetic peptide
RTFSGFTMSSTWMG

SEQ ID NO: 2418 - protein, 9 aa, Artificial Sequence
  Description of Artificial Sequence: Synthetic peptide
RTFRRYSMG

SEQ ID NO: 2419 - protein, 8 aa, Artificial Sequence
  Description of Artificial Sequence: Synthetic peptide
SIFSIGMG

SEQ ID NO: 2420 - protein, 9 aa, Artificial Sequence
  Description of Artificial Sequence: Synthetic peptide
RTFTSYRMG

SEQ ID NO: 2421 - protein, 12 aa, Artificial Sequence
  Description of Artificial Sequence: Synthetic peptide
RTFSSFRFRAMG

SEQ ID NO: 2422 - protein, 9 aa, Artificial Sequence
  Description of Artificial Sequence: Synthetic peptide
RTFGSYGMG

SEQ ID NO: 2423 - protein, 9 aa, Artificial Sequence
  Description of Artificial Sequence: Synthetic peptide
RTFRSYPMG

SEQ ID NO: 2424 - protein, 9 aa, Artificial Sequence
  Description of Artificial Sequence: Synthetic peptide
RTFSRSDMG

SEQ ID NO: 2425 - protein, 9 aa, Artificial Sequence
  Description of Artificial Sequence: Synthetic peptide
RTFRRYTMG

SEQ ID NO: 2426 - protein, 9 aa, Artificial Sequence
  Description of Artificial Sequence: Synthetic peptide
SIFRLSTMG

SEQ ID NO: 2427 - protein, 9 aa, Artificial Sequence
  Description of Artificial Sequence: Synthetic peptide
IAFRIRTMG

SEQ ID NO: 2428 - protein, 9 aa, Artificial Sequence
  Description of Artificial Sequence: Synthetic peptide
FTFTSYRMG

SEQ ID NO: 2429 - protein, 9 aa, Artificial Sequence
  Description of Artificial Sequence: Synthetic peptide
RTFSRYVMG

SEQ ID NO: 2430 - protein, 6 aa, Artificial Sequence
  Description of Artificial Sequence: Synthetic peptide
RTFSMG

SEQ ID NO: 2431 - protein, 9 aa, Artificial Sequence
  Description of Artificial Sequence: Synthetic peptide
RTFSTYTMG

SEQ ID NO: 2432 - protein, 9 aa, Artificial Sequence
  Description of Artificial Sequence: Synthetic peptide
RNLRMYRMG

SEQ ID NO: 2433 - protein, 9 aa, Artificial Sequence
  Description of Artificial Sequence: Synthetic peptide
ITIRTHAMG

SEQ ID NO: 2434 - protein, 9 aa, Artificial Sequence
  Description of Artificial Sequence: Synthetic peptide
RTFRRYHMG

SEQ ID NO: 2435 - protein, 9 aa, Artificial Sequence
  Description of Artificial Sequence: Synthetic peptide
RTFRRYTMG

SEQ ID NO: 2436 - protein, 9 aa, Artificial Sequence
  Description of Artificial Sequence: Synthetic peptide
RTFSWYPMG

SEQ ID NO: 2437 - protein, 9 aa, Artificial Sequence
  Description of Artificial Sequence: Synthetic peptide
RTFTSYRMG

SEQ ID NO: 2438 - protein, 9 aa, Artificial Sequence
  Description of Artificial Sequence: Synthetic peptide
RPLRRYVMG

SEQ ID NO: 2439 - protein, 9 aa, Artificial Sequence
  Description of Artificial Sequence: Synthetic peptide
RTFRRYAMG

SEQ ID NO: 2440 - protein, 9 aa, Artificial Sequence
  Description of Artificial Sequence: Synthetic peptide
RTFRRYTMG

SEQ ID NO: 2441 - protein, 9 aa, Artificial Sequence
  Description of Artificial Sequence: Synthetic peptide
RTLSTYNMG

SEQ ID NO: 2442 - protein, 9 aa, Artificial Sequence
  Description of Artificial Sequence: Synthetic peptide
RFFSTRVMG

SEQ ID NO: 2443 - protein, 9 aa, Artificial Sequence
  Description of Artificial Sequence: Synthetic peptide
RFFSICSMG

SEQ ID NO: 2444 - protein, 10 aa, Artificial Sequence
  Description of Artificial Sequence: Synthetic peptide
RMFSSRSNMG

SEQ ID NO: 2445 - protein, 9 aa, Artificial Sequence
  Description of Artificial Sequence: Synthetic peptide
RTFSSARMG

SEQ ID NO: 2446 - protein, 9 aa, Artificial Sequence
  Description of Artificial Sequence: Synthetic peptide
RTFRRYTMG

SEQ ID NO: 2447 - protein, 9 aa, Artificial Sequence
  Description of Artificial Sequence: Synthetic peptide
HTFRNYGMG

SEQ ID NO: 2448 - protein, 9 aa, Artificial Sequence
  Description of Artificial Sequence: Synthetic peptide
RTFSRYAMG

SEQ ID NO: 2449 - protein, 9 aa, Artificial Sequence
  Description of Artificial Sequence: Synthetic peptide
RNLRMYRMG

SEQ ID NO: 2450 - protein, 9 aa, Artificial Sequence
  Description of Artificial Sequence: Synthetic peptide
RTFRRYAMG

SEQ ID NO: 2451 - protein, 8 aa, Artificial Sequence
  Description of Artificial Sequence: Synthetic peptide
IPASMYLG

SEQ ID NO: 2452 - protein, 14 aa, Artificial Sequence
  Description of Artificial Sequence: Synthetic peptide
IPFRSRTFSAYAMG

SEQ ID NO: 2453 - protein, 13 aa, Artificial Sequence
  Description of Artificial Sequence: Synthetic peptide
AAISRSGRSTSYA

SEQ ID NO: 2454 - protein, 13 aa, Artificial Sequence
  Description of Artificial Sequence: Synthetic peptide
ATINYSGGGTYYA

SEQ ID NO: 2455 - protein, 13 aa, Artificial Sequence
  Description of Artificial Sequence: Synthetic peptide
AAISRSGKSTYYA

SEQ ID NO: 2456 - protein, 13 aa, Artificial Sequence
  Description of Artificial Sequence: Synthetic peptide
ALITPSSRTTYYA

SEQ ID NO: 2457 - protein, 13 aa, Artificial Sequence
  Description of Artificial Sequence: Synthetic peptide
ASINWGGGNTYYA

SEQ ID NO: 2458 - protein, 13 aa, Artificial Sequence
  Description of Artificial Sequence: Synthetic peptide
AAIRWSGGRTVYA

SEQ ID NO: 2459 - protein, 13 aa, Artificial Sequence
  Description of Artificial Sequence: Synthetic peptide
AAISWRGGNTYYA

SEQ ID NO: 2460 - protein, 13 aa, Artificial Sequence
  Description of Artificial Sequence: Synthetic peptide
AAISRSGGSTYYA

SEQ ID NO: 2461 - protein, 13 aa, Artificial Sequence
  Description of Artificial Sequence: Synthetic peptide
ASISRSGGSTYYA

SEQ ID NO: 2462 - protein, 13 aa, Artificial Sequence
  Description of Artificial Sequence: Synthetic peptide
ALINRSGGSQFYA

SEQ ID NO: 2463 - protein, 12 aa, Artificial Sequence
  Description of Artificial Sequence: Synthetic peptide
AGISRGGGTNYA

SEQ ID NO: 2464 - protein, 13 aa, Artificial Sequence
  Description of Artificial Sequence: Synthetic peptide
SSIYSDDGDSMYA

SEQ ID NO: 2465 - protein, 16 aa, Artificial Sequence
  Description of Artificial Sequence: Synthetic peptide
SAISWIIGSGGTTNYA

SEQ ID NO: 2466 - protein, 12 aa, Artificial Sequence
  Description of Artificial Sequence: Synthetic peptide
ASITKFGSTNYA

SEQ ID NO: 2467 - protein, 12 aa, Artificial Sequence
  Description of Artificial Sequence: Synthetic peptide
ASISSFGSTKYA

SEQ ID NO: 2468 - protein, 12 aa, Artificial Sequence
  Description of Artificial Sequence: Synthetic peptide
AAITSGGRKNYA

SEQ ID NO: 2469 - protein, 12 aa, Artificial Sequence
  Description of Artificial Sequence: Synthetic peptide
PAISSTGLASYT

SEQ ID NO: 2470 - protein, 13 aa, Artificial Sequence
  Description of Artificial Sequence: Synthetic peptide
ARIGYSGQSISYA

SEQ ID NO: 2471 - protein, 12 aa, Artificial Sequence
  Description of Artificial Sequence: Synthetic peptide
AQINRHGVTYYA

SEQ ID NO: 2472 - protein, 13 aa, Artificial Sequence
  Description of Artificial Sequence: Synthetic peptide
AGITGSGRSQYYA

SEQ ID NO: 2473 - protein, 12 aa, Artificial Sequence
  Description of Artificial Sequence: Synthetic peptide
AGISRGGSTNYA

SEQ ID NO: 2474 - protein, 13 aa, Artificial Sequence
  Description of Artificial Sequence: Synthetic peptide
AGISWSGARTHYA

SEQ ID NO: 2475 - protein, 13 aa, Artificial Sequence
  Description of Artificial Sequence: Synthetic peptide
ATIRWSDGSTYYA

SEQ ID NO: 2476 - protein, 12 aa, Artificial Sequence
  Description of Artificial Sequence: Synthetic peptide
ASISSSGRTSYA

SEQ ID NO: 2477 - protein, 13 aa, Artificial Sequence
  Description of Artificial Sequence: Synthetic peptide
AAISWSGRNINYA

SEQ ID NO: 2478 - protein, 12 aa, Artificial Sequence
  Description of Artificial Sequence: Synthetic peptide
AAISWSGSTSYA

SEQ ID NO: 2479 - protein, 12 aa, Artificial Sequence
  Description of Artificial Sequence: Synthetic peptide
ATWTSRGITTYA

SEQ ID NO: 2480 - protein, 12 aa, Artificial Sequence
  Description of Artificial Sequence: Synthetic peptide
ARITRGGITKYA

SEQ ID NO: 2481 - protein, 11 aa, Artificial Sequence
  Description of Artificial Sequence: Synthetic peptide
ARISPGGTFYA

SEQ ID NO: 2482 - protein, 12 aa, Artificial Sequence
  Description of Artificial Sequence: Synthetic peptide
ASISRSGTTMYA

SEQ ID NO: 2483 - protein, 12 aa, Artificial Sequence
  Description of Artificial Sequence: Synthetic peptide
ATINSRGITNYA

SEQ ID NO: 2484 - protein, 12 aa, Artificial Sequence
  Description of Artificial Sequence: Synthetic peptide
ARISRFGRTNYA

SEQ ID NO: 2485 - protein, 13 aa, Artificial Sequence
  Description of Artificial Sequence: Synthetic peptide
GAIDWSGRRITYA

SEQ ID NO: 2486 - protein, 12 aa, Artificial Sequence
  Description of Artificial Sequence: Synthetic peptide
ASITKFGSTNYA

SEQ ID NO: 2487 - protein, 12 aa, Artificial Sequence
  Description of Artificial Sequence: Synthetic peptide
ASINRGGSTKYA

SEQ ID NO: 2488 - protein, 13 aa, Artificial Sequence
  Description of Artificial Sequence: Synthetic peptide
ATINWSGGYTVYA

SEQ ID NO: 2489 - protein, 12 aa, Artificial Sequence
  Description of Artificial Sequence: Synthetic peptide
AGIITNGSTNYA

SEQ ID NO: 2490 - protein, 12 aa, Artificial Sequence
  Description of Artificial Sequence: Synthetic peptide
ASITPGGNTNYA

SEQ ID NO: 2491 - protein, 13 aa, Artificial Sequence
  Description of Artificial Sequence: Synthetic peptide
ARIWWRSGATYYA

SEQ ID NO: 2492 - protein, 13 aa, Artificial Sequence
  Description of Artificial Sequence: Synthetic peptide
AEISSSGGYTYYA

SEQ ID NO: 2493 - protein, 12 aa, Artificial Sequence
  Description of Artificial Sequence: Synthetic peptide
ALIFSGGSTYYA

SEQ ID NO: 2494 - protein, 12 aa, Artificial Sequence
  Description of Artificial Sequence: Synthetic peptide
ATISIGGRTYYA

SEQ ID NO: 2495 - protein, 12 aa, Artificial Sequence
  Description of Artificial Sequence: Synthetic peptide
ASINRGGSTNYA

SEQ ID NO: 2496 - protein, 13 aa, Artificial Sequence
  Description of Artificial Sequence: Synthetic peptide
AAISWSGGSTSYA

SEQ ID NO: 2497 - protein, 11 aa, Artificial Sequence
  Description of Artificial Sequence: Synthetic peptide
ASMRGSRSYYA

SEQ ID NO: 2498 - protein, 12 aa, Artificial Sequence
  Description of Artificial Sequence: Synthetic peptide
ASISSFGSTYYA

SEQ ID NO: 2499 - protein, 12 aa, Artificial Sequence
  Description of Artificial Sequence: Synthetic peptide
ASITSGGSTNYA

SEQ ID NO: 2500 - protein, 13 aa, Artificial Sequence
  Description of Artificial Sequence: Synthetic peptide
AGISRFFGTAYYA

SEQ ID NO: 2501 - protein, 12 aa, Artificial Sequence
  Description of Artificial Sequence: Synthetic peptide
ASISRFGRTNYA

SEQ ID NO: 2502 - protein, 12 aa, Artificial Sequence
  Description of Artificial Sequence: Synthetic peptide
ASISRFGRTNYA

SEQ ID NO: 2503 - protein, 13 aa, Artificial Sequence
  Description of Artificial Sequence: Synthetic peptide
ARIWRSGGNTYYA

SEQ ID NO: 2504 - protein, 12 aa, Artificial Sequence
  Description of Artificial Sequence: Synthetic peptide
ALISRVGVTSYA

SEQ ID NO: 2505 - protein, 13 aa, Artificial Sequence
  Description of Artificial Sequence: Synthetic peptide
ATISRSGGNTYYA

SEQ ID NO: 2506 - protein, 12 aa, Artificial Sequence
  Description of Artificial Sequence: Synthetic peptide
AAITSGGRTNYA

SEQ ID NO: 2507 - protein, 13 aa, Artificial Sequence
  Description of Artificial Sequence: Synthetic peptide
AVISWSGGSTKYA

SEQ ID NO: 2508 - protein, 13 aa, Artificial Sequence
  Description of Artificial Sequence: Synthetic peptide
ASISWGGARTYYA

SEQ ID NO: 2509 - protein, 13 aa, Artificial Sequence
  Description of Artificial Sequence: Synthetic peptide
AAITWNSGRTRYA

SEQ ID NO: 2510 - protein, 12 aa, Artificial Sequence
  Description of Artificial Sequence: Synthetic peptide
AAITNGGSTKYA

SEQ ID NO: 2511 - protein, 12 aa, Artificial Sequence
  Description of Artificial Sequence: Synthetic peptide
AAINRSGSTEYA

SEQ ID NO: 2512 - protein, 12 aa, Artificial Sequence
  Description of Artificial Sequence: Synthetic peptide
ASISRSGTTYYA

SEQ ID NO: 2513 - protein, 12 aa, Artificial Sequence
  Description of Artificial Sequence: Synthetic peptide
ASISRFGRTNYA

SEQ ID NO: 2514 - protein, 12 aa, Artificial Sequence
  Description of Artificial Sequence: Synthetic peptide
ARIWPGGSTYYA

SEQ ID NO: 2515 - protein, 14 aa, Artificial Sequence
  Description of Artificial Sequence: Synthetic peptide
AGINWRSGGSTYYA

SEQ ID NO: 2516 - protein, 12 aa, Artificial Sequence
  Description of Artificial Sequence: Synthetic peptide
ASISSGGTTAYA

SEQ ID NO: 2517 - protein, 12 aa, Artificial Sequence
  Description of Artificial Sequence: Synthetic peptide
AGINMISSTKYA

SEQ ID NO: 2518 - protein, 11 aa, Artificial Sequence
  Description of Artificial Sequence: Synthetic peptide
ARIAGGSTYYA

SEQ ID NO: 2519 - protein, 12 aa, Artificial Sequence
  Description of Artificial Sequence: Synthetic peptide
AAITSSGSTNYA

SEQ ID NO: 2520 - protein, 12 aa, Artificial Sequence
  Description of Artificial Sequence: Synthetic peptide
ASITKFGSTNYA

SEQ ID NO: 2521 - protein, 12 aa, Artificial Sequence
  Description of Artificial Sequence: Synthetic peptide
ASISRFGRTNYA

SEQ ID NO: 2522 - protein, 12 aa, Artificial Sequence
  Description of Artificial Sequence: Synthetic peptide
ARISSGGSTSYA

SEQ ID NO: 2523 - protein, 12 aa, Artificial Sequence
  Description of Artificial Sequence: Synthetic peptide
AAITSGGRTSYA

SEQ ID NO: 2524 - protein, 12 aa, Artificial Sequence
  Description of Artificial Sequence: Synthetic peptide
AQITRGGSTNYA

SEQ ID NO: 2525 - protein, 18 aa, Artificial Sequence
  Description of Artificial Sequence: Synthetic peptide
CAARRSQILFTSRTDYEW

SEQ ID NO: 2526 - protein, 22 aa, Artificial Sequence
  Description of Artificial Sequence: Synthetic peptide
CAAVNTFDESAYAAFACYDVVW

SEQ ID NO: 2527 - protein, 18 aa, Artificial Sequence
  Description of Artificial Sequence: Synthetic peptide
CAASSVFSDLRYRKNPKW

SEQ ID NO: 2528 - protein, 9 aa, Artificial Sequence
  Description of Artificial Sequence: Synthetic peptide
CAIAGRGRW

SEQ ID NO: 2529 - protein, 18 aa, Artificial Sequence
  Description of Artificial Sequence: Synthetic peptide
CAKTKRTGIFTTARMVDW

SEQ ID NO: 2530 - protein, 24 aa, Artificial Sequence
  Description of Artificial Sequence: Synthetic peptide
CAIEPGTIRNWRNRVPFARGNFGW

SEQ ID NO: 2531 - protein, 13 aa, Artificial Sequence
  Description of Artificial Sequence: Synthetic peptide
CAARRWIPPGPIW

SEQ ID NO: 2532 - protein, 17 aa, Artificial Sequence
  Description of Artificial Sequence: Synthetic peptide
CAAKRLRSFASGGSYDW

SEQ ID NO: 2533 - protein, 18 aa, Artificial Sequence
  Description of Artificial Sequence: Synthetic peptide
CAARRRVTLFTSRADYDW

SEQ ID NO: 2534 - protein, 13 aa, Artificial Sequence
  Description of Artificial Sequence: Synthetic peptide
CAARRWIPPGPIW

SEQ ID NO: 2535 - protein, 18 aa, Artificial Sequence
  Description of Artificial Sequence: Synthetic peptide
CAAKGIWDYLGRRDFGDW

SEQ ID NO: 2536 - protein, 23 aa, Artificial Sequence
  Description of Artificial Sequence: Synthetic peptide
CARQTFDFWSASLGGNFWYFDLW

SEQ ID NO: 2537 - protein, 9 aa, Artificial Sequence [sequence omitted]

SEQ ID NO: 2538 - protein, 16 aa, Artificial Sequence
  Description of Artificial Sequence: Synthetic peptide
CTRGGGRFFDWLYLRW

SEQ ID NO: 2539 - protein, 21 aa, Artificial Sequence
  Description of Artificial Sequence: Synthetic peptide
CARGHGRYFDWLLFARPPDYW

SEQ ID NO: 2540 - protein, 16 aa, Artificial Sequence
  Description of Artificial Sequence: Synthetic peptide
CAKRTIFGVGRWLDPW

SEQ ID NO: 2541 - protein, 20 aa, Artificial Sequence
  Description of Artificial Sequence: Synthetic peptide
CSKDRAPNCFACCPNGFDVW

SEQ ID NO: 2542 - protein, 12 aa, Artificial Sequence
  Description of Artificial Sequence: Synthetic peptide
CARGRFLGGTEW

SEQ ID NO: 2543 - protein, 18 aa, Artificial Sequence
  Description of Artificial Sequence: Synthetic peptide
CARGRTIFFGGGRYFDYW

SEQ ID NO: 2544 - protein, 25 aa, Artificial Sequence
  Description of Artificial Sequence: Synthetic peptide
CARGARIFGSVAPWRGGNYYGMDVW

SEQ ID NO: 2545 - protein, 15 aa, Artificial Sequence
  Description of Artificial Sequence: Synthetic peptide
CARASGLWFRRPHVW

SEQ ID NO: 2546 - protein, 21 aa, Artificial Sequence
  Description of Artificial Sequence: Synthetic peptide
CARVSRRPRSPPGYYYGMDVW

SEQ ID NO: 2547 - protein, 20 aa, Artificial Sequence
  Description of Artificial Sequence: Synthetic peptide
CTRARLRYFDWLFPTNFDYW

SEQ ID NO: 2548 - protein, 17 aa, Artificial Sequence
  Description of Artificial Sequence: Synthetic peptide
CARRVRRLWFRSYFDLW

SEQ ID NO: 2549 - protein, 16 aa, Artificial Sequence
  Description of Artificial Sequence: Synthetic peptide
CARERARWFGKFSVSW

SEQ ID NO: 2550 - protein, 11 aa, Artificial Sequence
  Description of Artificial Sequence: Synthetic peptide
SACGRLGFGAW

SEQ ID NO: 2551 - protein, 21 aa, Artificial Sequence
  Description of Artificial Sequence: Synthetic peptide
CARGGPPRLWGSYRRKYFDYW

SEQ ID NO: 2552 - protein, 13 aa, Artificial Sequence
  Description of Artificial Sequence: Synthetic peptide
CARGLGWLLGYYW

SEQ ID NO: 2553 - protein, 17 aa, Artificial Sequence
  Description of Artificial Sequence: Synthetic peptide
CTTSARSGWFWRYFDSW

SEQ ID NO: 2554 - protein, 20 aa, Artificial Sequence
  Description of Artificial Sequence: Synthetic peptide
CARRGLLQWFGAPNSWFDPW

SEQ ID NO: 2555 - protein, 19 aa, Artificial Sequence
  Description of Artificial Sequence: Synthetic peptide
CTTERDGLLWFRELFRPSW

SEQ ID NO: 2556 - protein, 16 aa, Artificial Sequence
  Description of Artificial Sequence: Synthetic peptide
CAKVHSYVWGGHSDYW

SEQ ID NO: 2557 - protein, 20 aa, Artificial Sequence
  Description of Artificial Sequence: Synthetic peptide
CARVRFSRLGGVIGRPIDSW

SEQ ID NO: 2558 - protein, 16 aa, Artificial Sequence
  Description of Artificial Sequence: Synthetic peptide
CAKDRGVLWFGELWYW

SEQ ID NO: 2559 - protein, 24 aa, Artificial Sequence
  Description of Artificial Sequence: Synthetic peptide
CASGKGGSATIFHLSRRPLYFDYW

SEQ ID NO: 2560 - protein, 20 aa, Artificial Sequence
  Description of Artificial Sequence: Synthetic peptide
CAKRKNRGPLWFGGGGWGYW

SEQ ID NO: 2561 - protein, 21 aa, Artificial Sequence
  Description of Artificial Sequence: Synthetic peptide
CARRVAYSSFWSGLRKHMDVW

SEQ ID NO: 2562 - protein, 14 aa, Artificial Sequence
  Description of Artificial Sequence: Synthetic peptide
CASRRRWLTPYIFW

SEQ ID NO: 2563 - protein, 12 aa, Artificial Sequence
  Description of Artificial Sequence: Synthetic peptide
CAAISIFGRLKW

SEQ ID NO: 2564 - protein, 21 aa, Artificial Sequence
  Description of Artificial Sequence: Synthetic peptide
CARVGPLRFLAQRPRLRPDYW

SEQ ID NO: 2565 - protein, 15 aa, Artificial Sequence
  Description of Artificial Sequence: Synthetic peptide
CAREWGRWLQRGSYW

SEQ ID NO: 2566 - protein, 24 aa, Artificial Sequence
  Description of Artificial Sequence: Synthetic peptide
CARGSGSGFMWYHGNNNYDRWRYW

SEQ ID NO: 2567 - protein, 19 aa, Artificial Sequence
  Description of Artificial Sequence: Synthetic peptide
CARGRYDFWSGYYRWFDPW

SEQ ID NO: 2568 - protein, 22 aa, Artificial Sequence
  Description of Artificial Sequence: Synthetic peptide
CATVPPPRRFLEWLPRRLTYIW

SEQ ID NO: 2569 - protein, 13 aa, Artificial Sequence
  Description of Artificial Sequence: Synthetic peptide
CARMSGFPFLDYW

SEQ ID NO: 2570 - protein, 18 aa, Artificial Sequence
  Description of Artificial Sequence: Synthetic peptide
CARTRGIFLWFGESFDYW

SEQ ID NO: 2571 - protein, 18 aa, Artificial Sequence
  Description of Artificial Sequence: Synthetic peptide
CARGGPRFGGFRGYFDPW

SEQ ID NO: 2572 - protein, 14 aa, Artificial Sequence
  Description of Artificial Sequence: Synthetic peptide
CARVTRWFGGLDVW

SEQ ID NO: 2573 - protein, 18 aa, Artificial Sequence
  Description of Artificial Sequence: Synthetic peptide
CARHHGLGILWWGTMDVW

SEQ ID NO: 2574 - protein, 15 aa, Artificial Sequence
  Description of Artificial Sequence: Synthetic peptide
CAKRSTWLPQHFDSW

SEQ ID NO: 2575 - protein, 16 aa, Artificial Sequence
  Description of Artificial Sequence: Synthetic peptide
CARGVRGVFRAYFDHW

SEQ ID NO: 2576 - protein, 23 aa, Artificial Sequence
  Description of Artificial Sequence: Synthetic peptide
CARGTSFFNFWSGSLGRVGFDSW

SEQ ID NO: 2577 - protein, 18 aa, Artificial Sequence
  Description of Artificial Sequence: Synthetic peptide
CTTAGVLRYFDWFRRPYW

SEQ ID NO: 2578 - protein, 21 aa, Artificial Sequence
  Description of Artificial Sequence: Synthetic peptide
CTTDGLRYFDWFPWASAFDIW

SEQ ID NO: 2579 - protein, 13 aa, Artificial Sequence
  Description of Artificial Sequence: Synthetic peptide
CARKGRWSGMNVW

SEQ ID NO: 2580 - protein, 21 aa, Artificial Sequence
  Description of Artificial Sequence: Synthetic peptide
CARSTGPRGSGRYRAHWFDSW

SEQ ID NO: 2581 - protein, 13 aa, Artificial Sequence
  Description of Artificial Sequence: Synthetic peptide
CSPSSWPFYFGAW

SEQ ID NO: 2582 - protein, 24 aa, Artificial Sequence
  Description of Artificial Sequence: Synthetic peptide
CARGTPWRLLWFGTLGPPPAFDYW

SEQ ID NO: 2583 - protein, 16 aa, Artificial Sequence
  Description of Artificial Sequence: Synthetic peptide
CARQHQDFWTGYYTVW

SEQ ID NO: 2584 - protein, 18 aa, Artificial Sequence
  Description of Artificial Sequence: Synthetic peptide
CAKEGWRWLQLRGGFDYW

SEQ ID NO: 2585 - protein, 17 aa, Artificial Sequence
  Description of Artificial Sequence: Synthetic peptide
CARRGKLSAAMHWFDPW

SEQ ID NO: 2586 - protein, 13 aa, Artificial Sequence
  Description of Artificial Sequence: Synthetic peptide
CARDRGIFGVSRW

SEQ ID NO: 2587 - protein, 11 aa, Artificial Sequence
  Description of Artificial Sequence: Synthetic peptide
CARGSGWWEYW

SEQ ID NO: 2588 - protein, 19 aa, Artificial Sequence
  Description of Artificial Sequence: Synthetic peptide
CARGFGRRFLEWLPRFDYW

SEQ ID NO: 2589 - protein, 16 aa, Artificial Sequence
  Description of Artificial Sequence: Synthetic peptide
CAHFRRFLPRGYVDYW

SEQ ID NO: 2590 - protein, 22 aa, Artificial Sequence
  Description of Artificial Sequence: Synthetic peptide
CARQQYYDFWSGYFRSGYFDLW

SEQ ID NO: 2591 - protein, 22 aa, Artificial Sequence
  Description of Artificial Sequence: Synthetic peptide
CATVPPPRRFLEWLPRRLTYTW

SEQ ID NO: 2592 - protein, 17 aa, Artificial Sequence
  Description of Artificial Sequence: Synthetic peptide
CAKERESRFLKWRKTDW

SEQ ID NO: 2593 - protein, 17 aa, Artificial Sequence
  Description of Artificial Sequence: Synthetic peptide
CARHDSIGLFRHGMDVW

SEQ ID NO: 2594 - protein, 20 aa, Artificial Sequence
  Description of Artificial Sequence: Synthetic peptide
CARDRGFGFWSGLRGYFDLW

SEQ ID NO: 2595 - protein, 20 aa, Artificial Sequence
  Description of Artificial Sequence: Synthetic peptide
CAKRKKRGPLWFGGGGWGYW

SEQ ID NO: 2596 - protein, 12 aa, Artificial Sequence
  Description of Artificial Sequence: Synthetic peptide
CARRHWFGFDYW

SEQ ID NO: 2597 - protein, 123 aa, Artificial Sequence
  Description of Artificial Sequence: Synthetic polypeptide
EVQLVESGGGLVQPGGSLRLSCAASGRTFSRLAMGWFRQAPGKEREFVAAISRSGRSTSYADSVKGRFTISADNSKNTAYLQMNSLKPEDTAVYYCAARRSQILFTSRTDYEWGQGTLVTVSS

SEQ ID NO: 2598 - protein, 126 aa, Artificial Sequence
  Description of Artificial Sequence: Synthetic polypeptide
EVQLVESGGGLVQPGGSLRLSCAASGSFSIAAMGWFRQAPGKEREFVATINYSGGGTYYADSVKGRFTISADNSKNTAYLQMNSLKPEDTAVYYCAAVNTFDESAYAAFACYDVVWGQGTLVTVSS

SEQ ID NO: 2599 - protein, 123 aa, Artificial Sequence
  Description of Artificial Sequence: Synthetic polypeptide
EVQLVESGGGLVQPGGSLRLSCAASGRTFSRYAMGWFRQAPGKEREFVAAISRSGKSTYYADSVKGRFTISADNSKNTAYLQMNSLKPEDTAVYYCAASSVFSDLRYRKNPKWGQGTLVTVSS

SEQ ID NO: 2600 - protein, 144 aa, Artificial Sequence
  Description of Artificial Sequence: Synthetic polypeptide
EVQLVESGGGLVQPGGSLRLSCAASGRTFSKYAMGWFRQAPGKEREFVSHISRDGGRTFSSSTMGWFRQAPGKERELVALITPSSRTTYYADSVKGRFTISADNSKNTAYLQMNSLKPEDTAVYYCAIAGRGRWGQGTLVTVSS

SEQ ID NO: 2601 - protein, 123 aa, Artificial Sequence
  Description of Artificial Sequence: Synthetic polypeptide
EVQLVESGGGLVQPGGSLRLSCAASGRTFRRYAMGWFRQAPGKEREFVASINWGGGNTYYADSVKGRFTISADNSKNTAYLQMNSLKPEDTAVYYCAKTKRTGIFTTARMVDWGQGTLVTVSS

SEQ ID NO: 2602 - protein, 129 aa, Artificial Sequence
  Description of Artificial Sequence: Synthetic polypeptide
EVQLVESGGGLVQPGGSLRLSCAASGRTFSRFAMGWFRQAPGKEREFVAAIRWSGGRTVYADSVKGRFTISADNSKNTAYLQMNSLKPEDTAVYYCAIEPGTIRNWRNRVPFARGNFGWGQGTLVTVSS

SEQ ID NO: 2603 - protein, 121 aa, Artificial Sequence
  Description of Artificial Sequence: Synthetic polypeptide
EVQLVESGGGLVQPGGSLRLSCAASGLGIAFSRRTAMGWFRQAPGKEREFVAAISWRGGNTYYADSVKGRFTISADNSKNTAYLQMNSLKPEDTAVYYCAARRWIPPGPIWGQGTLVTVSS

SEQ ID NO: 2604 - protein, 122 aa, Artificial Sequence
  Description of Artificial Sequence: Synthetic polypeptide
EVQLVESGGGLVQPGGSLRLSCAASGRTFRRYPMGWFRQAPGKEREFVAAISRSGGSTYYADSVKGRFTISADNSKNTAYLQMNSLKPEDTAVYYCAAKRLRSFASGGSYDWGQGTLVTVSS

SEQ ID NO: 2605 - protein, 123 aa, Artificial Sequence
  Description of Artificial Sequence: Synthetic polypeptide
EVQLVESGGGLVQPGGSLRLSCAASGGTLRGYGMGWFRQAPGKEREFVASISRSGGSTYYADSVKGRFTISADNSKNTAYLQMNSLKPEDTAVYYCAARRRVTLFTSRADYDWGQGTLVTVSS

SEQ ID NO: 2606 - protein, 118 aa, Artificial Sequence
  Description of Artificial Sequence: Synthetic polypeptide
EVQLVESGGGLVQPGGSLRLSCAASGRMFSSRSMGWFRQAPGKEREFVALINRSGGSQFYADSVKGRFTISADNSKNTAYLQMNSLKPEDTAVYYCAARRWIPPGPIWGQGTLVTVSS

SEQ ID NO: 2607 - protein, 122 aa, Artificial Sequence
  Description of Artificial Sequence: Synthetic polypeptide
EVQLVESGGGLVQPGGSLRLSCAASGRTFGRRAMGWFRQAPGKEREFVAGISRGGGTNYADSVKGRFTISADNSKNTAYLQMNSLKPEDTAVYYCAAKGIWDYLGRRDFGDWGQGTLVTVSS

SEQ ID NO: 2608 - protein, 131 aa, Artificial Sequence
  Description of Artificial Sequence: Synthetic polypeptide
EVQLVESGGGLVQPGGSLRLSCAASGLSSPPFDDFPMGWFRQAPGKEREFVSSIYSDDGDSMYADSVKGRFTISADNSKNTAYLQMNSLKPEDTAVYYCARQTFDFWSASLGGNFWYFDLWGQGTLVTVSS

SEQ ID NO: 2609 - protein, 117 aa, Artificial Sequence
  Description of Artificial Sequence: Synthetic polypeptide
EVQLVESGGGLVQPGGSLRLSCAASGGTFSSYSMGWFRQAPGKEREFVSAISWIIGSGGTTNYADSVKGRFTISADNSKNTAYLQMNSLKPEDTAVYYCTAGAGDSWGQGTLVTVSS

SEQ ID NO: 2610 - protein, 120 aa, Artificial Sequence
  Description of Artificial Sequence: Synthetic polypeptide
EVQLVESGGGLVQPGGSLRLSCAASGSIFSTRTMGWFRQAPGKEREFVASITKFGSTNYADSVKGRFTISADNSKNTAYLQMNSLKPEDTAVYYCTRGGGRFFDWLYLRWGQGTLVTVSS

SEQ ID NO: 2611 - protein, 125 aa, Artificial Sequence
  Description of Artificial Sequence: Synthetic polypeptide
EVQLVESGGGLVQPGGSLRLSCAASGRTLWRSNMGWFRQAPGKEREFVASISSFGSTKYADSVKGRFTISADNSKNTAYLQMNSLKPEDTAVYYCARGHGRYFDWLLFARPPDYWGQGTLVTVSS

SEQ ID NO: 2612 - protein, 120 aa, Artificial Sequence
  Description of Artificial Sequence: Synthetic polypeptide
EVQLVESGGGLVQPGGSLRLSCAASGRSLGIYRMGWFRQAPGKEREFVAAITSGGRKNYADSVKGRFTISADNSKNTAYLQMNSLKPEDTAVYYCAKRTIFGVGRWLDPWGQGTLVTVSS

SEQ ID NO: 2613 - protein, 124 aa, Artificial Sequence
  Description of Artificial Sequence: Synthetic polypeptide
EVQLVESGGGLVQPGGSLRLSCAASGTTLTFRIMGWFRQAPGKEREFVPAISSTGLASYTDSVKGRFTISADNSKNTAYLQMNSLKPEDTAVYYCSKDRAPNCFACCPNGFDVWGQGTLVTVSS

SEQ ID NO: 2614 - protein, 121 aa, Artificial Sequence
  Description of Artificial Sequence: Synthetic polypeptide
EVQLVESGGGLVQPGGSLRLSCAASGSRFSGRFNILNMGWFRQAPGKEREFVARIGYSGQSISYADSVKGRFTISADNSKNTAYLQMNSLKPEDTAVYYCARGRFLGGTEWGQGTLVTVSS

SEQ ID NO: 2615 - protein, 122 aa, Artificial Sequence
  Description of Artificial Sequence: Synthetic polypeptide
EVQLVESGGGLVQPGGSLRLSCAASGTLFKINAMGWFRQAPGKEREFVAQINRHGVTYYADSVKGRFTISADNSKNTAYLQMNSLKPEDTAVYYCARGRTIFFGGGRYFDYWGQGTLVTVSS

SEQ ID NO: 2616 - protein, 130 aa, Artificial Sequence
  Description of Artificial Sequence: Synthetic polypeptide
EVQLVESGGGLVQPGGSLRLSCAASGIPFRSRTMGWFRQAPGKEREFVAGITGSGRSQYYADSVKGRFTISADNSKNTAYLQMNSLKPEDTAVYYCARGARIFGSVAPWRGGNYYGMDVWGQGTLVTVSS

SEQ ID NO: 2617 - protein, 119 aa, Artificial Sequence
  Description of Artificial Sequence: Synthetic polypeptide
EVQLVESGGGLVQPGGSLRLSCAASGFTFSSFRMGWFRQAPGKEREFVAGISRGGSTNYADSVKGRFTISADNSKNTAYLQMNSLKPEDTAVYYCARASGLWFRRPHVWGQGTLVTVSS

SEQ ID NO: 2618 - protein, 126 aa, Artificial Sequence
  Description of Artificial Sequence: Synthetic polypeptide
EVQLVESGGGLVQPGGSLRLSCAASGRNFRRNSMGWFRQAPGKEREFVAGISWSGARTHYADSVKGRFTISADNSKNTAYLQMNSLKPEDTAVYYCARVSRRPRSPPGYYYGMDVWGQGTLVTVSS

SEQ ID NO: 2619 - protein, 125 aa, Artificial Sequence
  Description of Artificial Sequence: Synthetic polypeptide
EVQLVESGGGLVQPGGSLRLSCAASGRNLRMYRMGWFRQAPGKEREFVATIRWSDGSTYYADSVKGRFTISADNSKNTAYLQMNSLKPEDTAVYYCTRARLRYFDWLFPTNFDYWGQGTLVTVSS

SEQ ID NO: 2620 - protein, 122 aa, Artificial Sequence
  Description of Artificial Sequence: Synthetic polypeptide
EVQLVESGGGLVQPGGSLRLSCAASGGLTFSSNTMGWFRQAPGKEREFVASISSSGRTSYADSVKGRFTISADNSKNTAYLQMNSLKPEDTAVYYCARRVRRLWFRSYFDLWGQGTLVTVSS

SEQ ID NO: 2621 - protein, 121 aa, Artificial Sequence
  Description of Artificial Sequence: Synthetic polypeptide
EVQLVESGGGLVQPGGSLRLSCAASGFTLAYYAMGWFRQAPGKEREFVAAISWSGRNINYADSVKGRFTISADNSKNTAYLQMNSLKPEDTAVYYCARERARWFGKFSVSWGQGTLVTVSS

SEQ ID NO: 2622 - protein, 115 aa, Artificial Sequence
  Description of Artificial Sequence: Synthetic polypeptide
EVQLVESGGGLVQPGGSLRLSCAASGRTFSSFPMGWFRQAPGKEREFVAAISWSGSTSYADSVKGRFTISADNSKNTAYLQMNSLKPEDTAVYYSACGRLGFGAWGQGTLVTVSS

SEQ ID NO: 2623 - protein, 125 aa, Artificial Sequence
  Description of Artificial Sequence: Synthetic polypeptide
EVQLVESGGGLVQPGGSLRLSCAASGISSSKRNMGWFRQAPGKEREFVATWTSRGITTYADSVKGRFTISADNSKNTAYLQMNSLKPEDTAVYYCARGGPPRLWGSYRRKYFDYWGQGTLVTVSS

SEQ ID NO: 2624 - protein, 117 aa, Artificial Sequence
  Description of Artificial Sequence: Synthetic polypeptide
EVQLVESGGGLVQPGGSLRLSCAASGRTFSIYAMGWFRQAPGKEREFVARITRGGITKYADSVKGRFTISADNSKNTAYLQMNSLKPEDTAVYYCARGLGWLLGYYWGQGTLVTVSS

SEQ ID NO: 2625 - protein, 120 aa, Artificial Sequence
  Description of Artificial Sequence: Synthetic polypeptide
EVQLVESGGGLVQPGGSLRLSCAASGRMYNSYSMGWFRQAPGKEREFVARISPGGTFYADSVKGRFTISADNSKNTAYLQMNSLKPEDTAVYYCTTSARSGWFWRYFDSWGQGTLVTVSS

SEQ ID NO: 2626 - protein, 124 aa, Artificial Sequence
  Description of Artificial Sequence: Synthetic polypeptide
EVQLVESGGGLVQPGGSLRLSCAASGRTFRSYGMGWFRQAPGKEREFVASISRSGTTMYADSVKGRFTISADNSKNTAYLQMNSLKPEDTAVYYCARRGLLQWFGAPNSWFDPWGQGTLVTVSS

SEQ ID NO: 2627 - protein, 121 aa, Artificial Sequence
  Description of Artificial Sequence: Synthetic polypeptide
EVQLVESGGGLVQPGGSLRLSCAASGRTIRTMGWFRQAPGKEREFVATINSRGITNYADSVKGRFTISADNSKNTAYLQMNSLKPEDTAVYYCTTERDGLLWFRELFRPSWGQGTLVTVSS

SEQ ID NO: 2628 - protein, 120 aa, Artificial Sequence
  Description of Artificial Sequence: Synthetic polypeptide
EVQLVESGGGLVQPGGSLRLSCAASGRSFSFNAMGWFRQAPGKEREFVARISRFGRTNYADSVKGRFTISADNSKNTAYLQMNSLKPEDTAVYYCAKVHSYVWGGHSDYWGQGTLVTVSS

SEQ ID NO: 2629 - protein, 123 aa, Artificial Sequence
  Description of Artificial Sequence: Synthetic polypeptide
EVQLVESGGGLVQPGGSLRLSCAASGRTYYAMGWFRQAPGKEREFVGAIDWSGRRITYADSVKGRFTISADNSKNTAYLQMNSLKPEDTAVYYCARVRFSRLGGVIGRPIDSWGQGTLVTVSS

SEQ ID NO: 2630 - protein, 120 aa, Artificial Sequence
  Description of Artificial Sequence: Synthetic polypeptide
EVQLVESGGGLVQPGGSLRLSCAASGRAFRRYTMGWFRQAPGKEREFVASITKFGSTNYADSVKGRFTISADNSKNTAYLQMNSLKPEDTAVYYCAKDRGVLWFGELWYWGQGTLVTVSS

SEQ ID NO: 2631 - protein, 128 aa, Artificial Sequence
  Description of Artificial Sequence: Synthetic polypeptide
EVQLVESGGGLVQPGGSLRLSCAASGRTFSNYRMGWFRQAPGKEREFVASINRGGSTKYADSVKGRFTISADNSKNTAYLQMNSLKPEDTAVYYCASGKGGSATIFHLSRRPLYFDYWGQGTLVTVSS

SEQ ID NO: 2632 - protein, 125 aa, Artificial Sequence
  Description of Artificial Sequence: Synthetic polypeptide
EVQLVESGGGLVQPGGSLRLSCAASGITFSPYAMGWFRQAPGKEREFVATINWSGGYTVYADSVKGRFTISADNSKNTAYLQMNSLKPEDTAVYYCAKRKNRGPLWFGGGGWGYWGQGTLVTVSS

SEQ ID NO: 2633 - protein, 130 aa, Artificial Sequence
  Description of Artificial Sequence: Synthetic polypeptide
EVQLVESGGGLVQPGGSLRLSCAASGRTFSGFTMSSTWMGWFRQAPGKEREFVAGIITNGSTNYADSVKGRFTISADNSKNTAYLQMNSLKPEDTAVYYCARRVAYSSFWSGLRKHMDVWGQGTLVTVSS

SEQ ID NO: 2634 - protein, 118 aa, Artificial Sequence
  Description of Artificial Sequence: Synthetic polypeptide
EVQLVESGGGLVQPGGSLRLSCAASGRTFRRYSMGWFRQAPGKEREFVASITPGGNTNYADSVKGRFTISADNSKNTAYLQMNSLKPEDTAVYYCASRRRWLTPYIFWGQGTLVTVSS

SEQ ID NO: 2635 - protein, 116 aa, Artificial Sequence
  Description of Artificial Sequence: Synthetic polypeptide
EVQLVESGGGLVQPGGSLRLSCAASGSIFSIGMGWFRQAPGKEREFVARIWWRSGATYYADSVKGRFTISADNSKNTAYLQMNSLKPEDTAVYYCAAISIFGRLKWGQGTLVTVSS

SEQ ID NO: 2636 - protein, 126 aa, Artificial Sequence
  Description of Artificial Sequence: Synthetic polypeptide
EVQLVESGGGLVQPGGSLRLSCAASGRTFTSYRMGWFRQAPGKEREFVAEISSSGGYTYYADSVKGRFTISADNSKNTAYLQMNSLKPEDTAVYYCARVGPLRFLAQRPRLRPDYWGQGTLVTVSS

SEQ ID NO: 2637 - protein, 122 aa, Artificial Sequence
  Description of Artificial Sequence: Synthetic polypeptide
EVQLVESGGGLVQPGGSLRLSCAASGRTFSSFRFRAMGWFRQAPGKEREFVALIFSGGSTYYADSVKGRFTISADNSKNTAYLQMNSLKPEDTAVYYCAREWGRWLQRGSYWGQGTLVTVSS

SEQ ID NO: 2638 - protein, 128 aa, Artificial Sequence
  Description of Artificial Sequence: Synthetic polypeptide
EVQLVESGGGLVQPGGSLRLSCAASGRTFGSYGMGWFRQAPGKEREFVATISIGGRTYYADSVKGRFTISADNSKNTAYLQMNSLKPEDTAVYYCARGSGSGFMWYHGNNNYDRWRYWGQGTLVTVSS

SEQ ID NO: 2639 - protein, 123 aa, Artificial Sequence
  Description of Artificial Sequence: Synthetic polypeptide
EVQLVESGGGLVQPGGSLRLSCAASGRTFRSYPMGWFRQAPGKEREFVASINRGGSTNYADSVKGRFTISADNSKNTAYLQMNSLKPEDTAVYYCARGRYDFWSGYYRWFDPWGQGTLVTVSS

SEQ ID NO: 2640 - protein, 127 aa, Artificial Sequence
  Description of Artificial Sequence: Synthetic polypeptide
EVQLVESGGGLVQPGGSLRLSCAASGRTFSRSDMGWFRQAPGKEREFVAAISWSGGSTSYADSVKGRFTISADNSKNTAYLQMNSLKPEDTAVYYCATVPPPRRFLEWLPRRLTYIWGQGTLVTVSS

SEQ ID NO: 2641 - protein, 116 aa, Artificial Sequence
  Description of Artificial Sequence: Synthetic polypeptide
EVQLVESGGGLVQPGGSLRLSCAASGRTFRRYTMGWFRQAPGKEREFVASMRGSRSYYADSVKGRFTISADNSKNTAYLQMNSLKPEDTAVYYCARMSGFPFLDYWGQGTLVTVSS

SEQ ID NO: 2642 - protein, 122 aa, Artificial Sequence
  Description of Artificial Sequence: Synthetic polypeptide
EVQLVESGGGLVQPGGSLRLSCAASGSIFRLSTMGWFRQAPGKEREFVASISSFGSTYYADSVKGRFTISADNSKNTAYLQMNSLKPEDTAVYYCARTRGIFLWFGESFDYWGQGTLVTVSS

SEQ ID NO: 2643 - protein, 122 aa, Artificial Sequence
  Description of Artificial Sequence: Synthetic polypeptide
EVQLVESGGGLVQPGGSLRLSCAASGIAFRIRTMGWFRQAPGKEREFVASITSGGSTNYADSVKGRFTISADNSKNTAYLQMNSLKPEDTAVYYCARGGPRFGGFRGYFDPWGQGTLVTVSS

SEQ ID NO: 2644 - protein, 119 aa, Artificial Sequence
  Description of Artificial Sequence: Synthetic polypeptide
EVQLVESGGGLVQPGGSLRLSCAASGFTFTSYRMGWFRQAPGKEREFVAGISRFFGTAYYADSVKGRFTISADNSKNTAYLQMNSLKPEDTAVYYCARVTRWFGGLDVWGQGTLVTVSS

SEQ ID NO: 2645 - protein, 122 aa, Artificial Sequence
  Description of Artificial Sequence: Synthetic polypeptide
EVQLVESGGGLVQPGGSLRLSCAASGRTFSRYVMGWFRQAPGKEREFVASISRFGRTNYADSVKGRFTISADNSKNTAYLQMNSLKPEDTAVYYCARHHGLGILWWGTMDVWGQGTLVTVSS

SEQ ID NO: 2646 - protein, 116 aa, Artificial Sequence
  Description of Artificial Sequence: Synthetic polypeptide
EVQLVESGGGLVQPGGSLRLSCAASGRTFSMGWFRQAPGKEREFVASISRFGRTNYADSVKGRFTISADNSKNTAYLQMNSLKPEDTAVYYCAKRSTWLPQHFDSWGQGTLVTVSS

SEQ ID NO: 2647 - protein, 121 aa, Artificial Sequence
  Description of Artificial Sequence: Synthetic polypeptide
EVQLVESGGGLVQPGGSLRLSCAASGRTFSTYTMGWFRQAPGKEREFVARIWRSGGNTYYADSVKGRFTISADNSKNTAYLQMNSLKPEDTAVYYCARGVRGVFRAYFDHWGQGTLVTVSS

SEQ ID NO: 2648 - protein, 127 aa, Artificial Sequence
  Description of Artificial Sequence: Synthetic polypeptide
EVQLVESGGGLVQPGGSLRLSCAASGRNLRMYRMGWFRQAPGKEREFVALISRVGVTSYADSVKGRFTISADNSKNTAYLQMNSLKPEDTAVYYCARGTSFFNFWSGSLGRVGFDSWGQGTLVTVSS

SEQ ID NO: 2649 - protein, 123 aa, Artificial Sequence
  Description of Artificial Sequence: Synthetic polypeptide
EVQLVESGGGLVQPGGSLRLSCAASGITIRTHAMGWFRQAPGKEREFVATISRSGGNTYYADSVKGRFTISADNSKNTAYLQMNSLKPEDTAVYYCTTAGVLRYFDWFRRPYWGQGTLVTVSS

SEQ ID NO: 2650 - protein, 125 aa, Artificial Sequence
  Description of Artificial Sequence: Synthetic polypeptide
EVQLVESGGGLVQPGGSLRLSCAASGRTFRRYHMGWFRQAPGKEREFVAAITSGGRTNYADSVKGRFTISADNSKNTAYLQMNSLKPEDTAVYYCTTDGLRYFDWFPWASAFDIWGQGTLVTVSS

SEQ ID NO: 2651 - protein, 118 aa, Artificial Sequence
  Description of Artificial Sequence: Synthetic polypeptide
EVQLVESGGGLVQPGGSLRLSCAASGRTFRRYTMGWFRQAPGKEREFVAVISWSGGSTKYADSVKGRFTISADNSKNTAYLQMNSLKPEDTAVYYCARKGRWSGMNVWGQGTLVTVSS

SEQ ID NO: 2652 - protein, 126 aa, Artificial Sequence
  Description of Artificial Sequence: Synthetic polypeptide
EVQLVESGGGLVQPGGSLRLSCAASGRTFSWYPMGWFRQAPGKEREFVASISWGGARTYYADSVKGRFTISADNSKNTAYLQMNSLKPEDTAVYYCARSTGPRGSGRYRAHWFDSWGQGTLVTVSS

SEQ ID NO: 2653 - protein, 118 aa, Artificial Sequence
  Description of Artificial Sequence: Synthetic polypeptide
EVQLVESGGGLVQPGGSLRLSCAASGRTFTSYRMGWFRQAPGKEREFVAAITWNSGRTRYADSVKGRFTISADNSKNTAYLQMNSLKPEDTAVYYCSPSSWPFYFGAWGQGTLVTVSS

SEQ ID NO: 2654 - protein, 128 aa, Artificial Sequence
  Description of Artificial Sequence: Synthetic polypeptide
EVQLVESGGGLVQPGGSLRLSCAASGRPLRRYVMGWFRQAPGKEREFVAAITNGGSTKYADSVKGRFTISADNSKNTAYLQMNSLKPEDTAVYYCARGTPWRLLWFGTLGPPPAFDYWGQGTLVTVSS

SEQ ID NO: 2655 - protein, 120 aa, Artificial Sequence
  Description of Artificial Sequence: Synthetic polypeptide
EVQLVESGGGLVQPGGSLRLSCAASGRTFRRYAMGWFRQAPGKEREFVAAINRSGSTEYADSVKGRFTISADNSKNTAYLQMNSLKPEDTAVYYCARQHQDFWTGYYTVWGQGTLVTVSS

SEQ ID NO: 2656 - protein, 122 aa, Artificial Sequence
  Description of Artificial Sequence: Synthetic polypeptide
EVQLVESGGGLVQPGGSLRLSCAASGRTFRRYTMGWFRQAPGKEREFVASISRSGTTYYADSVKGRFTISADNSKNTAYLQMNSLKPEDTAVYYCAKEGWRWLQLRGGFDYWGQGTLVTVSS

SEQ ID NO: 2657 - protein, 121 aa, Artificial Sequence
  Description of Artificial Sequence: Synthetic polypeptide
EVQLVESGGGLVQPGGSLRLSCAASGRTLSTYNMGWFRQAPGKEREFVASISRFGRTNYADSVKGRFTISADNSKNTAYLQMNSLKPEDTAVYYCARRGKLSAAMHWFDPWGQGTLVTVSS

SEQ ID NO: 2658 - protein, 117 aa, Artificial Sequence
  Description of Artificial Sequence: Synthetic polypeptide
EVQLVESGGGLVQPGGSLRLSCAASGRFFSTRVMGWFRQAPGKEREFVARIWPGGSTYYADSVKGRFTISADNSKNTAYLQMNSLKPEDTAVYYCARDRGIFGVSRWGQGTLVTVSS

SEQ ID NO: 2659 - protein, 117 aa, Artificial Sequence
  Description of Artificial Sequence: Synthetic polypeptide
EVQLVESGGGLVQPGGSLRLSCAASGRFFSICSMGWFRQAPGKEREFVAGINWRSGGSTYYADSVKGRFTISADNSKNTAYLQMNSLKPEDTAVYYCARGSGWWEYWGQGTLVTVSS

SEQ ID NO: 2660 - protein, 124 aa, Artificial Sequence
  Description of Artificial Sequence: Synthetic polypeptide
EVQLVESGGGLVQPGGSLRLSCAASGRMFSSRSNMGWFRQAPGKEREFVASISSGGTTAYADSVKGRFTISADNSKNTAYLQMNSLKPEDTAVYYCARGFGRRFLEWLPRFDYWGQGTLVTVSS

SEQ ID NO: 2661 - protein, 120 aa, Artificial Sequence
  Description of Artificial Sequence: Synthetic polypeptide
EVQLVESGGGLVQPGGSLRLSCAASGRTFSSARMGWFRQAPGKEREFVAGINMISSTKYADSVKGRFTISADNSKNTAYLQMNSLKPEDTAVYYCAHFRRFLPRGYVDYWGQGTLVTVSS

SEQ ID NO: 2662 - protein, 125 aa, Artificial Sequence
  Description of Artificial Sequence: Synthetic polypeptide
EVQLVESGGGLVQPGGSLRLSCAASGRTFRRYTMGWFRQAPGKEREFVARIAGGSTYYADSVKGRFTISADNSKNTAYLQMNSLKPEDTAVYYCARQQYYDFWSGYFRSGYFDLWGQGTLVTVSS

SEQ ID NO: 2663 - protein, 126 aa, Artificial Sequence
  Description of Artificial Sequence: Synthetic polypeptide
EVQLVESGGGLVQPGGSLRLSCAASGHTFRNYGMGWFRQAPGKEREFVAAITSSGSTNYADSVKGRFTISADNSKNTAYLQMNSLKPEDTAVYYCATVPPPRRFLEWLPRRLTYTWGQGTLVTVSS

SEQ ID NO: 2664 - protein, 121 aa, Artificial Sequence
  Description of Artificial Sequence: Synthetic polypeptide
EVQLVESGGGLVQPGGSLRLSCAASGRTFSRYAMGWFRQAPGKEREFVASITKFGSTNYADSVKGRFTISADNSKNTAYLQMNSLKPEDTAVYYCAKERESRFLKWRKTDWGQGTLVTVSS

SEQ ID NO: 2665 - protein, 121 aa, Artificial Sequence
  Description of Artificial Sequence: Synthetic polypeptide
EVQLVESGGGLVQPGGSLRLSCAASGRNLRMYRMGWFRQAPGKEREFVASISRFGRTNYADSVKGRFTISADNSKNTAYLQMNSLKPEDTAVYYCARHDSIGLFRHGMDVWGQGTLVTVSS

SEQ ID NO: 2666 - protein, 124 aa, Artificial Sequence
  Description of Artificial Sequence: Synthetic polypeptide
EVQLVESGGGLVQPGGSLRLSCAASGRTFRRYAMGWFRQAPGKEREFVARISSGGSTSYADSVKGRFTISADNSKNTAYLQMNSLKPEDTAVYYCARDRGFGFWSGLRGYFDLWGQGTLVTVSS

SEQ ID NO: 2667 - protein, 123 aa, Artificial Sequence
  Description of Artificial Sequence: Synthetic polypeptide
EVQLVESGGGLVQPGGSLRLSCAASGIPASMYLGWFRQAPGKEREFVAAITSGGRTSYADSVKGRFTISADNSKNTAYLQMNSLKPEDTAVYYCAKRKKRGPLWFGGGGWGYWGQGTLVTVSS

SEQ ID NO: 2668 - protein, 121 aa, Artificial Sequence
  Description of Artificial Sequence: Synthetic polypeptide
EVQLVESGGGLVQPGGSLRLSCAASGIPFRSRTFSAYAMGWFRQAPGKEREFVAQITRGGSTNYADSVKGRFTISADNSKNTAYLQMNSLKPEDTAVYYCARRHWFGFDYWGQGTLVTVSS

SEQ ID NO: 2669 - DNA, 1520 bp, Artificial Sequence
  Description of Artificial Sequence: Synthetic polynucleotide
atgggatggtcatgtatcatcctttttctggtagcaactgcaactggagtacatagcgaggtgcagctggtcgagtctggcggtggcttggtgcaacccggcggcagcttgagactgtcttgcgccgcctccgggttcaccttctccccaagttggatgggatggtttcggcaagccccaggcaaggaacgcgaattcgtggccactatcaatgaatacggcggccggaactacgccgactccgtgaaagggcgatttacaatttccgctgataactccaagaacaccgcatatctgcaaatgaacagcctcaagcctgaggacacagccgtctactattgtgctagagtggaccgggactttgactactggggtcagggtacactggttacggtttcctcgggaggaggcggaagcgaacccaagtcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggcggcggaggtggatctgggggcggcggttccgcttctgaggttcagctcgtagaatccggtggaggacttgttcaacctggaggtagtctgaggctgagctgtgctgcaagtggcagcacatttagcatcaatgctatgggttggttccgacaagctccagggaaggagcgcgagttcgtggctgggatcaccagctctggaggctataccaactacgctgactctgtcaaaggtcgctttaccatatcggccgacaattctaagaatactgcctacctgcaaatgaactccctgaagcctgaagacaccgccgtgtattactgcgccgctgatggcgtgccggagtacagcgattacgcgtcgggaccagtctggggccaaggcacatggtgactgtatcgtcgtaatag

SEQ ID NO: 2670 - protein, 505 aa, Artificial Sequence
  Description of Artificial Sequence: Synthetic polypeptide
MGWSCIILFLVATATGVHSEVQLVESGGGLVQPGGSLRLSCAASGFTFSPSWMGWFRQAPGKEREFVATINEYGGRNYADSVKGRFTISADNSKNTAYLQMNSLKPEDTAVYYCARVDRDFDYWGQGTLVTVSSGGGGSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSASEVQLVESGGGLVQPGGSLRLSCAASGSTFSINAMGWFRQAPGKEREFVAGITSSGGYTNYADSVKGRFTISADNSKNTAYLQMNSLKPEDTAVYYCAADGVPEYSDYASGPVWGQGTLVTVSS

SEQ ID NO: 2671 - protein, 5 aa, Artificial Sequence
  Description of Artificial Sequence: Synthetic peptide
GGGGS

SEQ ID NO: 2672 - protein, 6 aa, Artificial Sequence
  Description of Artificial Sequence: Synthetic 6xHis tag
HHHHHH

SEQ ID NO: 2673 - DNA, 62 bp, Artificial Sequence
  Description of Artificial Sequence: Synthetic oligonucleotide
  modified_base (51)..(52): Thymidine-succinyl hexamide CED phosphoramidite
agacaatcaaccatttggggtggacagccttgacctctagacttcggcattttttttttttt

SEQ ID NO: 2674 - DNA, 112 bp, Artificial Sequence
  Description of Artificial Sequence: Synthetic polynucleotide
  modified_base (101)..(102): Thymidine-succinyl hexamide CED phosphoramidite
cgggatccttatcgtcatcgtcgtacagatcccgacccatttgctgtccaccagtcatgctagccataccatgatgatgatgatgatgagaaccccgcattttttttttttt

SEQ ID NO: 2675 - DNA, 19 bp, Artificial Sequence
  Description of Artificial Sequence: Synthetic primer
atgcggggttctcatcatc

SEQ ID NO: 2676 - DNA, 20 bp, Artificial Sequence
  Description of Artificial Sequence: Synthetic primer
cgggatccttatcgtcatcg

SEQ ID NO: 2677 - DNA, 1458 bp, Artificial Sequence
  Description of Artificial Sequence: Synthetic polynucleotide
gaggtgcagctggtcgagtctggcggtggcttggtgcaacccggcggcagcttgagactgtcttgcgccgcctccgggttcaccttctccccaagttggatgggatggtttcggcaagccccaggcaaggaacgcgaattcgtggccactatcaatgaatacggcggccggaactacgccgactccgtgaaagggcgatttacaatttccgctgataactccaagaacaccgcatatctgcaaatgaacagcctcaagcctgaggacacagccgtctactattgtgctagagtggaccgggactttgactactggggtcagggtacactggttacggtttcctcgggaggaggcggaagcgaacccaagtcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggcggcggaggtggatctgggggcggcggttccgcttctgaggttcagctcgtagaatccggtggaggacttgttcaacctggaggtagtctgaggctgagctgtgctgcaagtggcagcacatttagcatcaatgctatgggttggttccgacaagctccagggaaggagcgcgagttcgtggctgggatcaccagctctggaggctataccaactacgctgactctgtcaaaggtcgctttaccatatcggccgacaattctaagaatactgcctacctgcaaatgaactccctgaagcctgaagacaccgccgtgtattactgcgccgctgatggcgtgccggagtacagcgattacgcgtcgggaccagtctggggccaaggcacactggtgactgtatcgtcg

SEQ ID NO: 2678 - protein, 486 aa, Artificial Sequence
  Description of Artificial Sequence: Synthetic polypeptide
EVQLVESGGGLVQPGGSLRLSCAASGFTFSPSWMGWFRQAPGKEREFVATINEYGGRNYADSVKGRFTISADNSKNTAYLQMNSLKPEDTAVYYCARVDRDFDYWGQGTLVTVSSGGGGSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSASEVQLVESGGGLVQPGGSLRLSCAASGSTFSINAMGWFRQAPGKEREFVAGITSSGGYTNYADSVKGRFTISADNSKNTAYLQMNSLKPEDTAVYYCAADGVPEYSDYASGPVWGQGTLVTVSS

SEQ ID NO: 2679 - protein, 1273 aa, Artificial Sequence
  Description of Artificial Sequence: Synthetic polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

What is claimed is:

1. A bispecific antibody with at least 90% similarity to SEQ ID NO: 2670.

2. A method of treating SARS-COV-2, the method comprising:

a. administering an antibody to a subject wherein the antibody is at least 90% similar to SEQ ID NO: 2670.

* * * * *